(12) United States Patent
Geierstanger et al.

(10) Patent No.: US 9,585,970 B2
(45) Date of Patent: Mar. 7, 2017

(54) SITE-SPECIFIC LABELING METHODS AND MOLECULES PRODUCED THEREBY

(71) Applicants: Bernhard Hubert Geierstanger, Solana Beach, CA (US); Jan Grunewald, San Diego, CA (US); Badry Bursulaya, Escondito, CA (US)

(72) Inventors: Bernhard Hubert Geierstanger, Solana Beach, CA (US); Jan Grunewald, San Diego, CA (US); Badry Bursulaya, Escondito, CA (US)

(73) Assignee: Novartis AG, Basel (CH)

( * ) Notice: Subject to any disclaimer, the term of this patent is extended or adjusted under 35 U.S.C. 154(b) by 208 days.

(21) Appl. No.: 13/906,584

(22) Filed: May 31, 2013

(65) Prior Publication Data
US 2014/0065171 A1    Mar. 6, 2014

Related U.S. Application Data

(60) Provisional application No. 61/777,430, filed on Mar. 12, 2013, provisional application No. 61/655,143, filed on Jun. 4, 2012.

(51) Int. Cl.
| *A61K 39/395* | (2006.01) |
| *C07K 16/30* | (2006.01) |
| *A61K 47/48* | (2006.01) |
| *C07K 16/00* | (2006.01) |
| *C07K 16/32* | (2006.01) |

(52) U.S. Cl.
CPC ..... *A61K 47/48715* (2013.01); *A61K 47/4843* (2013.01); *A61K 47/48438* (2013.01); *A61K 47/48569* (2013.01); *C07K 16/00* (2013.01); *C07K 16/30* (2013.01); *C07K 16/32* (2013.01); *C07K 2317/24* (2013.01); *C07K 2317/94* (2013.01); *C07K 2318/10* (2013.01); *C07K 2319/90* (2013.01)

(58) Field of Classification Search
None
See application file for complete search history.

(56) References Cited

U.S. PATENT DOCUMENTS

| 5,342,947 | A | * | 8/1994 | Lackey et al. | 546/41 |
| 6,150,584 | A | * | 11/2000 | Kucherlapati et al. | 800/18 |
| 7,192,735 | B2 | | 3/2007 | Lambalot et al. | |
| 7,666,612 | B2 | | 2/2010 | Johnsson et al. | |
| 2010/0173384 | A1 | | 7/2010 | Johnsson et al. | |
| 2010/0304430 | A1 | | 12/2010 | Burkart et al. | |
| 2011/0206616 | A1 | | 8/2011 | Ichtchenko et al. | |

FOREIGN PATENT DOCUMENTS

| WO | WO2006/072620 | * | 7/2006 |
| WO | 2007041689 A2 | | 4/2007 |
| WO | 2007/069089 A2 | | 6/2007 |
| WO | 2009092808 A1 | | 7/2009 |

OTHER PUBLICATIONS

Clarke et al., "In vivo reporter labeling of proteins via metabolic delivery of coenzyme a analogues." J Am Chem Soc 127(32): 11234-11235 (2005).
Fischbach et al., "Assembly-line enzymology for polyketide and nonribosomal Peptide antibiotics: logic, machinery, and mechanisms." Chem Rev 106(8):3468-3496 (2006).
George et al., "Specific labeling of cell surface proteins with chemically diverse compounds," J Am Chem Soc 126(29): 8896-8897 (2004).
Gronemeyer et al., "Adding value to fusion proteins through covalent labelling." Curr Opin Biotechnol 16(4): 453-458 (2005).
Hinner and Johnsson, "How to obtain labeled proteins and what to do with them." Curr Opin Biotechnol 21(6): 766-776 (2010).
Johnsson et al. "Protein chemistry on the surface of living cells." Chembiochem 6(1): 47-52 (2005).
Koglin et al., "Conformational switches modulate protein interactions in peptide antibiotic synthetases." Science 312(5771):273-276 (2006).
La Clair et al., "Manipulation of carrier proteins in antibiotic biosynthesis." Chemistry & Biology 11(2):195-201 (Feb. 2004).
Lambalot et al, "A new enzyme superfamily—the phosphopantetheinyl transferases." Chemistry & Biology 3(11):923-936 (Nov. 1996).
Meier et al., "Synthesis and evaluation of bioorthogonal pantetheine analogues for in vivo protein modification." J Am Chem Soc 128(37):12174-12184 (2006).
Mercer et al., "Fluorescent multiplex analysis of carrier protein post-translational modification." Chembiochem 6(8):1335-1337 (2005).
Mercer et al., "In vivo modification of native carrier protein domains." Chembiochem 10(6):1091-1100 (2009).
Meyer et al., "FRET imaging reveals that functional neurokinin-1 receptors are monomeric and reside in membrane microdomains of live cells." Proc Natl Acad Sci U S A 103(7):2138-2143 (2006).
Molina et al., "Trastuzumab (herceptin), a humanized anti-Her2 receptor monoclonal antibody, inhibits basal and activated Her2 ectodomain cleavage in breast cancer cells." Cancer Res 61(12):4744-4749 (2001).
Mosiewicz et al., "Phosphopantetheinyl transferase-catalyzed formation of bioactive hydrogels for tissue engineering." J Am Chem Soc 132(17):5972-5974 (2010).
Prummer et al., "Post-translational covalent labeling reveals heterogeneous mobility of individual G protein-coupled receptors in living cells." Chembiochem 7(6):908-911 (2006).
Saphire et al., "Crystal structure of a neutralizing human IGG against HIV-1: a template for vaccine design." Science 293:1155-1159 (2001).

(Continued)

*Primary Examiner* — Karen Canella

(57) ABSTRACT

The present invention provides methods of site-specific labeling of antibodies, using proteins having 4'-phosphopantetheinyl transferase activity that catalyze post-translational modification of peptide sequences ("peptide tags") incorporated into one or more specific sites of an antibody of interest. Enzymatic labeling enables quantitative and irreversible covalent modification of a specific serine residue within the peptide tags incorporated into the antibody, and thus creates desirable antibody conjugates.

6 Claims, 36 Drawing Sheets

(56) References Cited

OTHER PUBLICATIONS

Sunbul et al., "Enzyme-Catalyzed Substrate Attachment to Phage Surfaces for the Selection of Catalytic Activities," Chembiochem 12(3):380-386 (2011).
Sunbul et al., "Catalytic turnover-based phage selection for engineering the substrate specificity of Sfp phosphopantetheinyl transferase." J Mol Biol 387(4):883-898 (2009).
Sunbul et al., "Enzyme catalyzed site-specific protein labeling and cell imaging with quantum dots." Chem Commun 45:5927-5929 (2008).
Sunbul et al., "Chapter 10 Using phosphopantetheinyl transferases for enzyme posttranslational activation, site specific protein labeling and identification of natural product biosynthetic gene clusters from bacterial genomes." Methods in Enzymology 458:255-275 (2009).
Vivero-Pol et al., "Multicolor imaging of cell surface proteins." J Am Chem Soc 127(37):12770-12771 (2005).
Waichman et al., "Functional immobilization and patterning of proteins by an enzymatic transfer reaction." Anal Chem 82(4):1478-1485 (2010).
Wong et al., "Site-selective immobilisation of functional enzymes on to polystyrene nanoparticles." Org Biomol Chem 8(4):782-787 (2010).
Wong et al., "Direct site-selective covalent protein immobilization catalyzed by a phosphopantetheinyl transferase." J Am Chem Soc 130(37):12456-12464 (2008).
Yin et al., "Single-cell FRET imaging of transferrin receptor trafficking dynamics by Sfp-catalyzed, site-specific protein labeling." Chem Biol 12(9):999-1006 (Sep. 2005).
Yin et al., "Site-specific protein labeling by Sfp phosphopantetheinyl transferase." Nat Protoc 1(1):280-285 (2006).
Yin et al, "Labeling proteins with small molecules by site-specific posttranslational modification." J Am Chem Soc 126 (25):7754-7755 (2004).
Yin et al., "Phagemid encoded small molecules for high throughput screening of chemical libraries." J Am Chem Soc 126(42):13570-13571 (2004).
Yin, J. et al. "Genetically encoded short peptide tag for versatile protein labeling by Sfp phosphopantetheinyl transferase." Proc Natl Acad Sci USA 102(44):15815-15820 (Nov. 1, 2005).
Zhou, Z. et al. "Genetically encoded short peptide tags for orthogonal protein labeling by Sfp and AcpS phosphopantetheinyl transferases." ACS Chem Biol 2(5):337-346 (2007).
Zhou, Z. et al. "An eight residue fragment of an acyl carrier protein suffices for post-translational introduction of fluorescent pantetheinyl arms in protein modification in vitro and in vivo." J Am Chem Soc 130(30): 9925-9930 (2008).
Zhang et al. "Fluorescent site-specific labeling of *Escherichia coli* expressed proteins with Sfp phosphopantetheinyl transferase," Methods Mol Biol 705:295-307 (2011).
Dall'aglio et al., "Analysis of Streptomyces coelicolor phosphopantetheinyl transferase, AcpS, reveals the basis for relaxed substrate specificity," Biochemistry 50(25):5704-5717 (2011).
Rothmann et al., "Resin-based investigation of acyl carrier protein interaction networks in *Escherichia coli*," Bioorganic & medicinal chemistry 20(2):667-671 (2012).
Duckworth and Aldrich, "Development of a high-throughput fluorescence polarization assay for the discovery of phosphopantetheinyl transferase inhibitors," Analytical biochemistry 403(1-2):13-19 (2010).
Kosa et al., "Reversible labeling of native and fusion-protein motifs," Nature methods 9(10):981-984 (Oct. 2012).
Mary et al., "On-chip background noise reduction for cell-based assays in droplets," Lab Chip 11(12):2066-2070 (2011).
Chen I, Dorr BM, & Liu DR (2011) A general strategy for the evolution of bond-forming enzymes using yeast display. Proceedings of the National Academy of Sciences of the United States of America 108(28):11399-11404.
Waichman et al., "Maleimide photolithography for single-molecule protein-protein interaction analysis in micropatterns," Analytical chemistry 83(2):501-508 (2011).
Wong et al., "A methodology for preparing nanostructured biomolecular interfaces with high enzymatic activity," Nanoscale 4(2):659-666 (2012).
Yasgar et al., "A strategy to discover inhibitors of Bacillus subtilis surfactin-type phosphopantetheinyl transferase," Molecular BioSystems 6(2):365-375 (2010).
Treutlein et al., "Dynamic architecture of a minimal RNA polymerase II open promoter complex," Molecular cell 46(2):136-146 (Apr. 27, 2012).
Worthington & Burkart, "One-pot chemo-enzymatic synthesis of reporter-modified proteins," Organic & biomolecular chemistry 4(1):44-46 (2006).
Meier et al., "Practical 4'-phosphopantetheine active site discovery from proteomic samples," Journal of proteome research 10(1):320-329 (2011).
Ishikawa et al., "Sulfonyl 3-alkynyl pantetheinamides as mechanism-based cross-linkers of acyl carrier protein dehydratase," Journal of the American Chemical Society 135(24):8846-8849 (2013).
Worthington et al., "Activity-guided engineering of natural product carrier proteins," Molecular bioSystems 7(2):365-370 (2011).

* cited by examiner

| | | |
|---|---|---|
| 119 | STKGPSVFPLAPSSKSTSGGTAALGCLVKDYFPEPVTVSWNSGALTSGVHTFPAVLQSS | 177 |
| 178 | GLYSLSSVVTVPSSSLGTQTYICNVNHKPSNTKVDKX'₁VEPKSCDKTHTCPPCPAPELLGG | 237 |
| 238 | PSVFLFPPKPKDTLMISRTPEVTCVVVDVSHEDPEVKFNWYVDGVEVHNAKTKPREEQYN | 297 |
| 298 | STYRVVSVLTVLHQDWLNGKEYKCKVSNKALPAPIEKTISKAKGQPREPQVYTLPPSRX'₂E | 357 |
| 358 | X'₃TKNQVSLTCLVKGFYPSDIAVEWESNGQPENNYKTTPPVLDSDGSFFLYSKLTVDKSRW | 417 |
| 418 | QQGNVFSCSVMHEX'₄LHNHYTQKSLSLSPG | 446 |

B

| | | |
|---|---|---|
| 109 | TVAAPSVFIFPPSDEQLKSGTASVVCLLNNFYPREAKVQWKVDNX'₅LQSGNSQESVTEQDS | 168 |
| 169 | KDSTYSLSSTLTLSKADYEKHKX'₆YACEVTHQGLSSPVTKSFNRGEC | 214 |

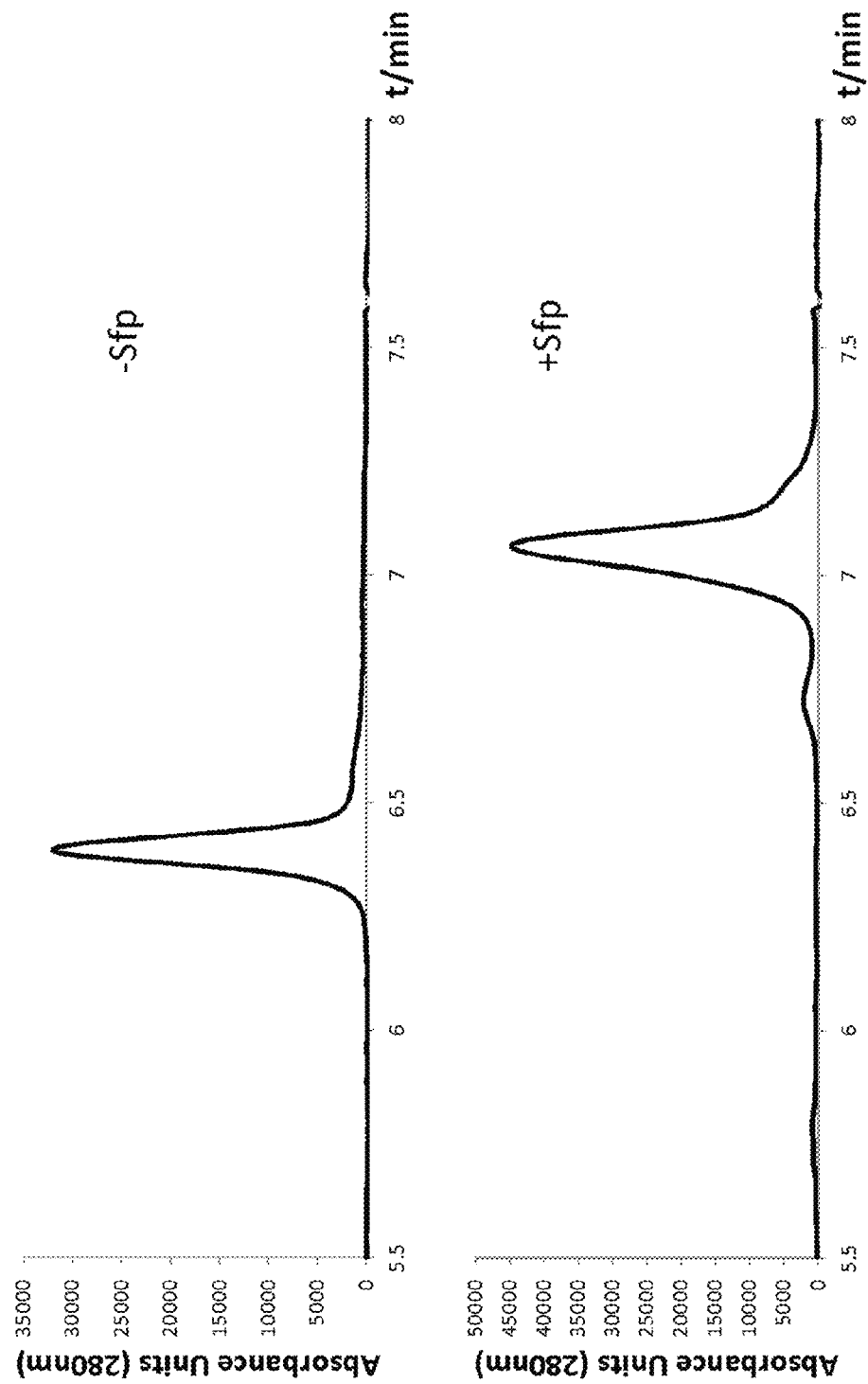

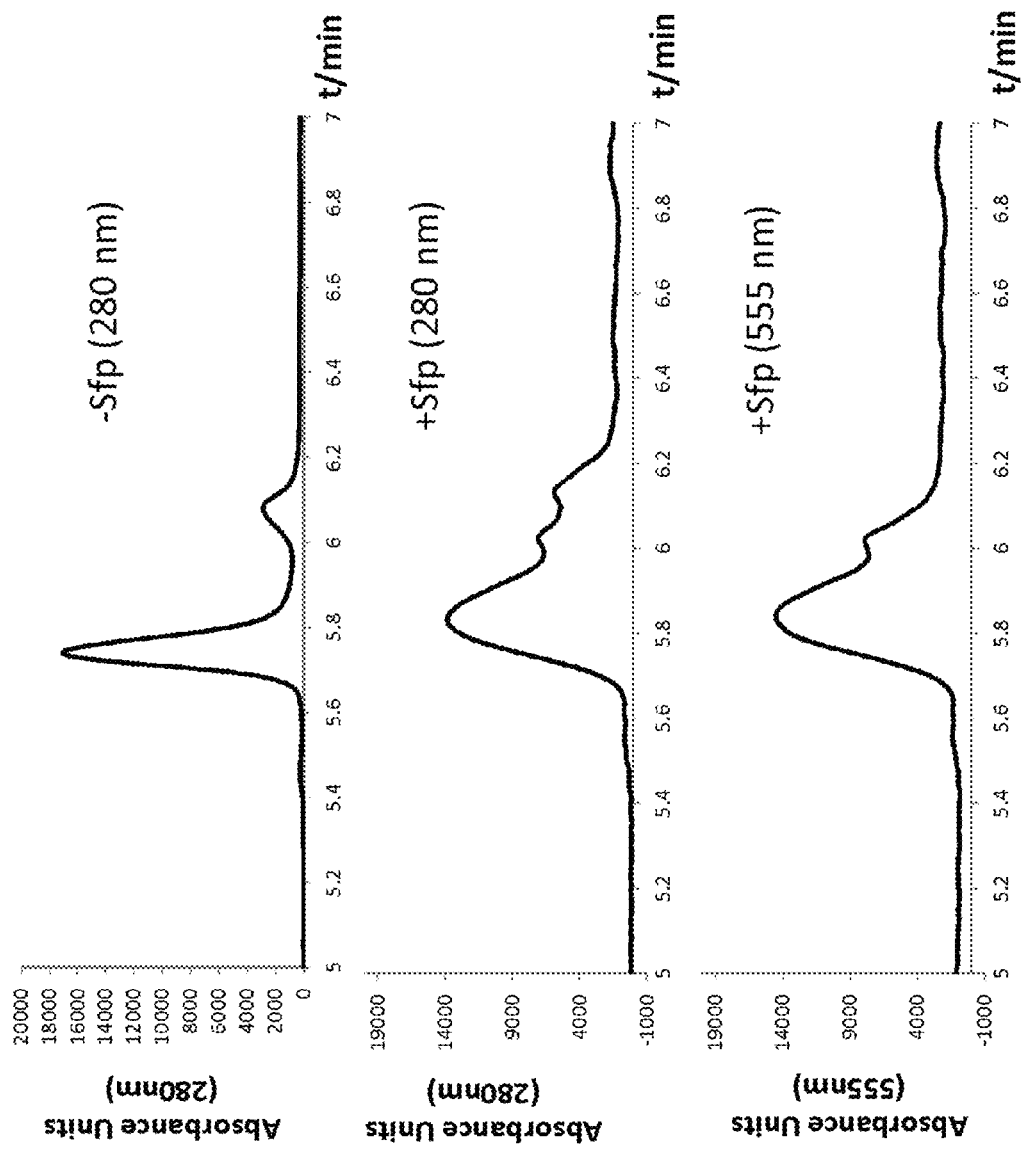

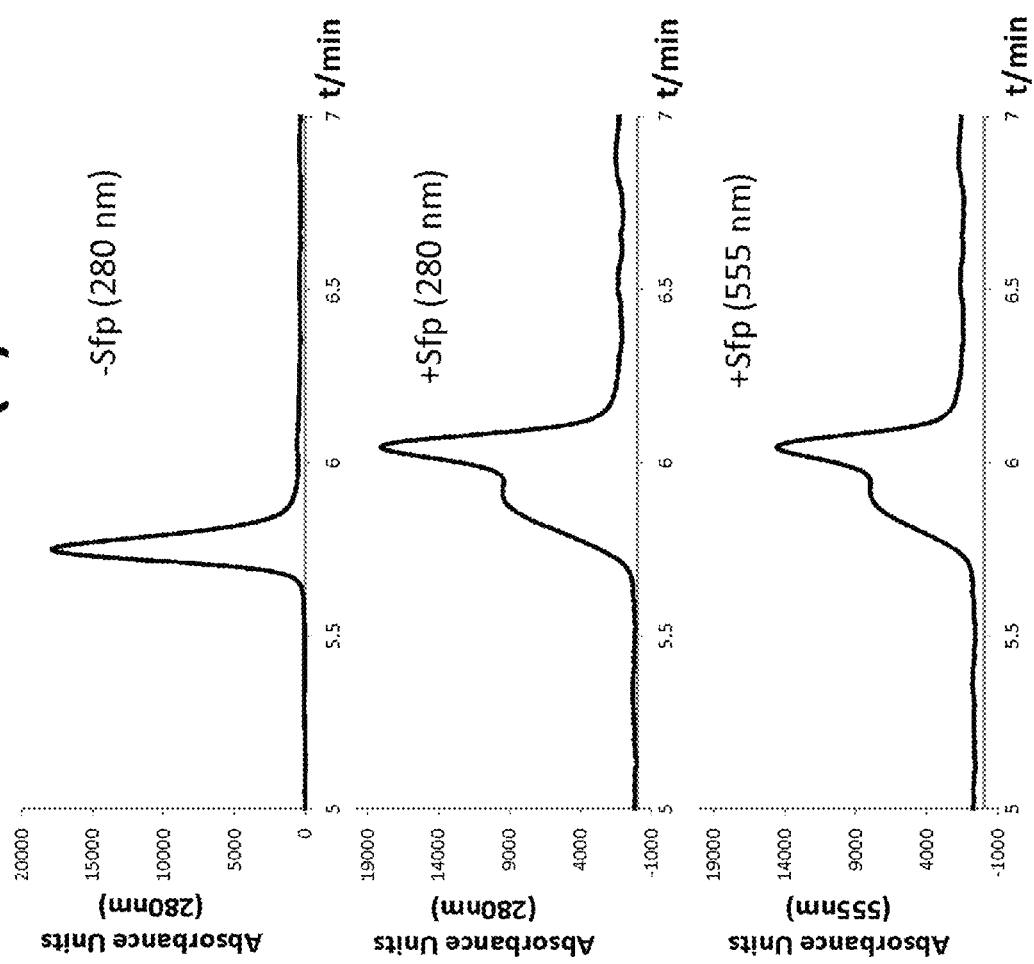

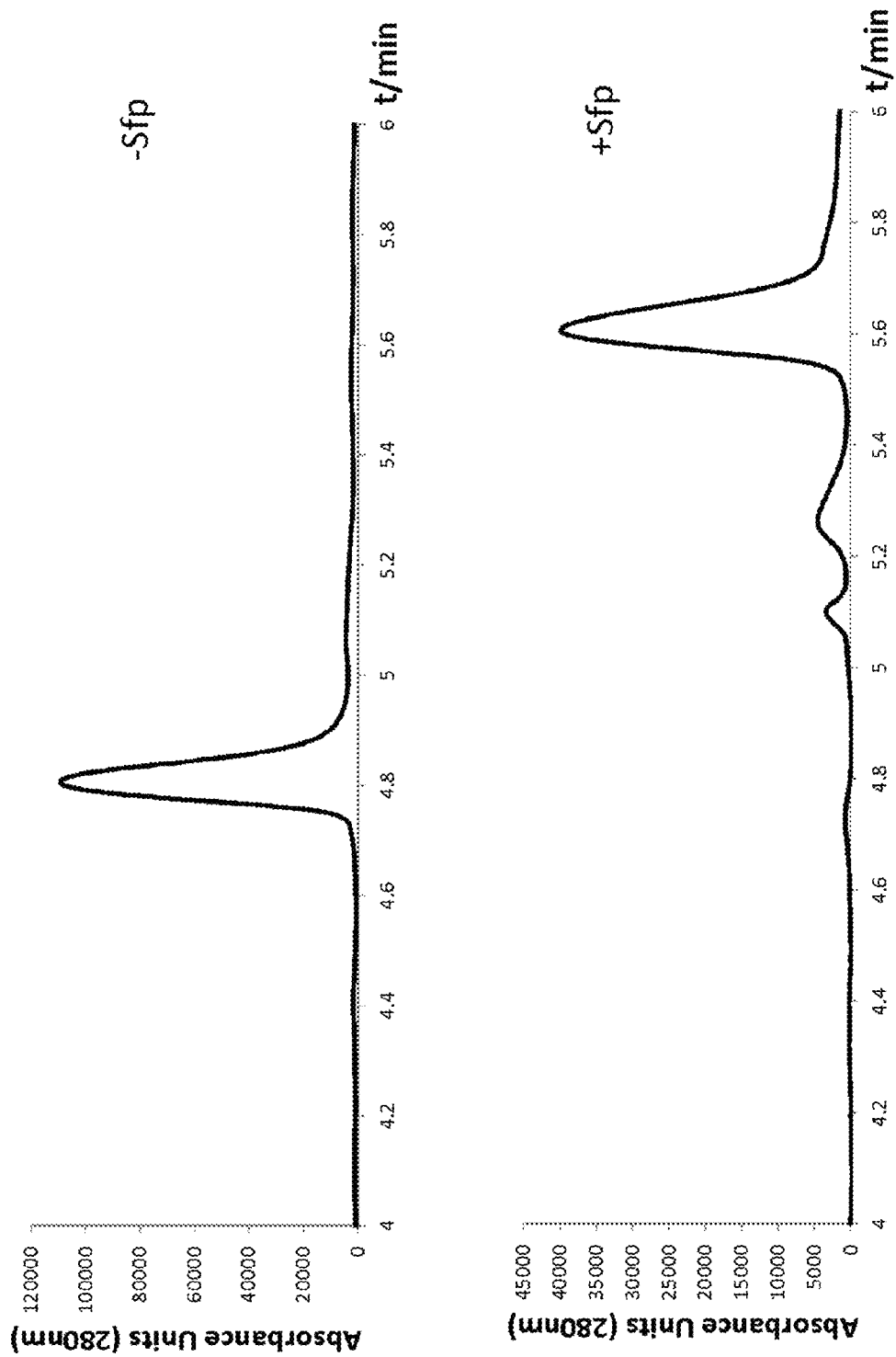

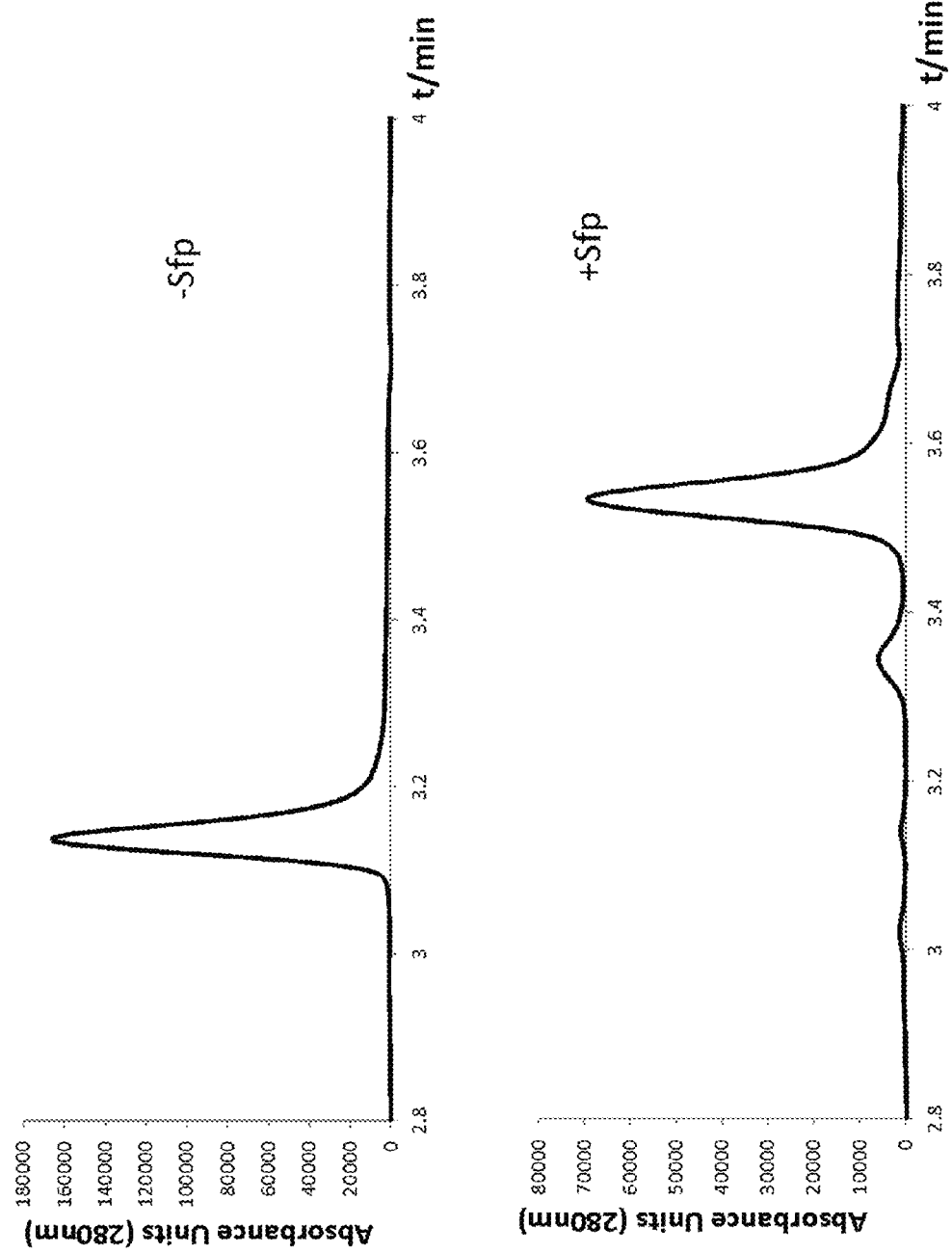

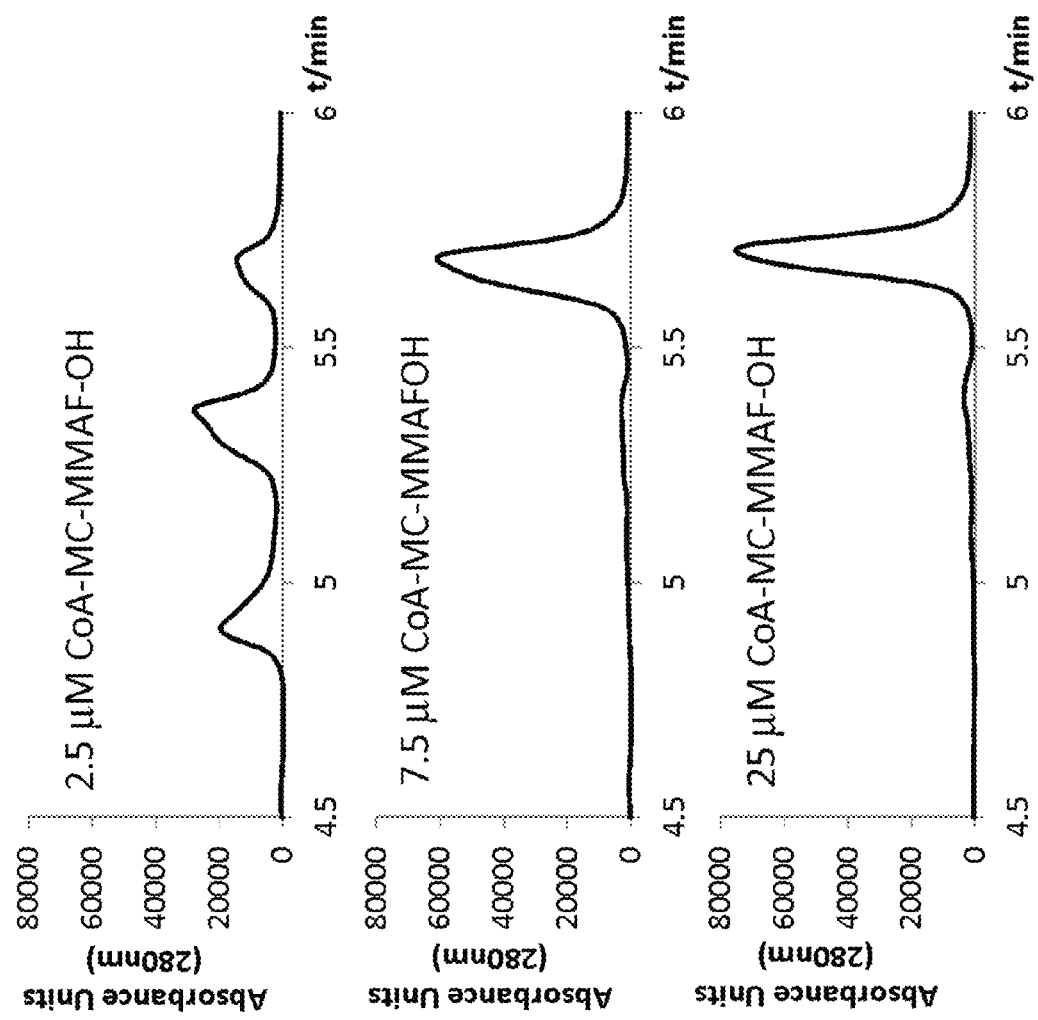

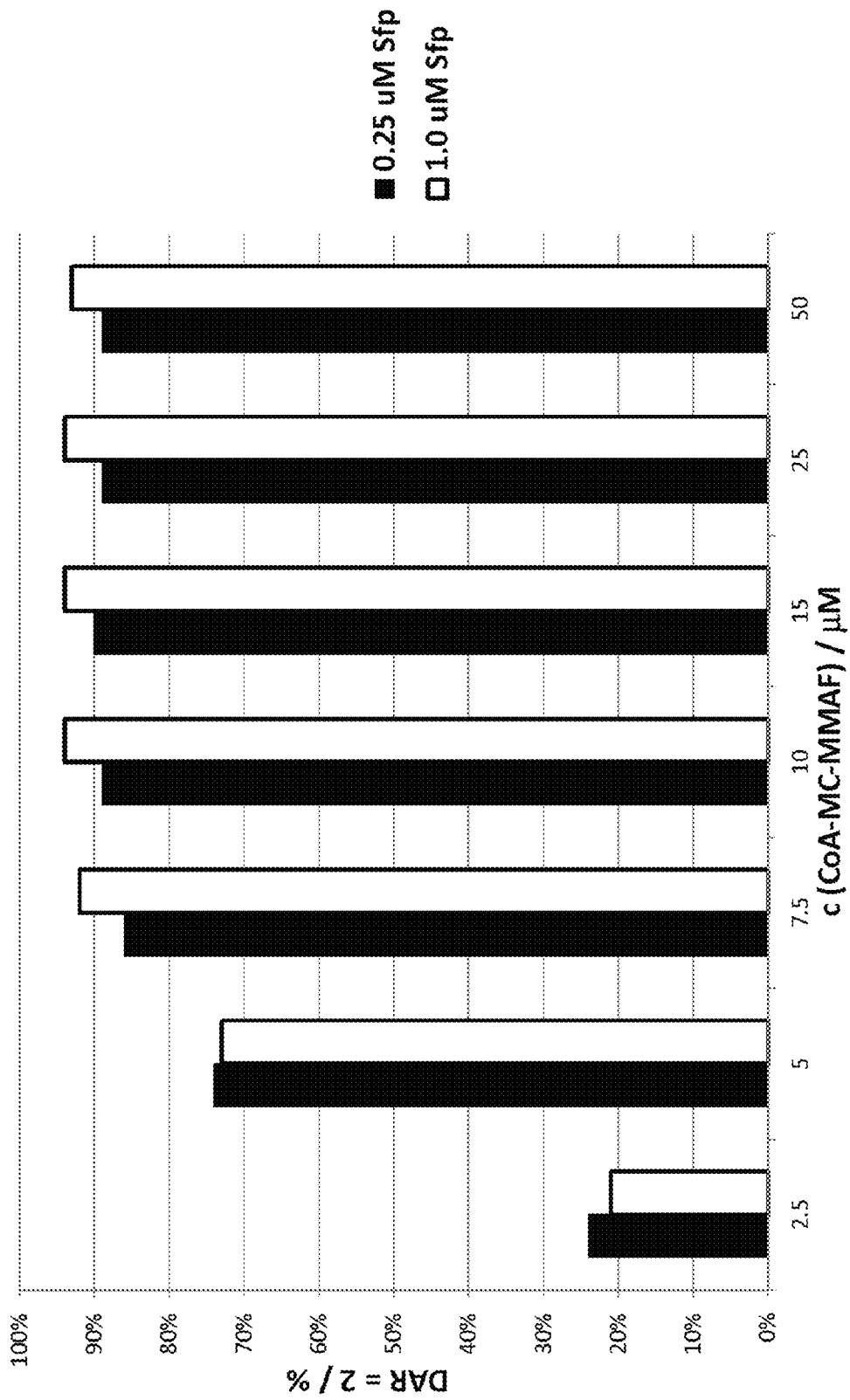

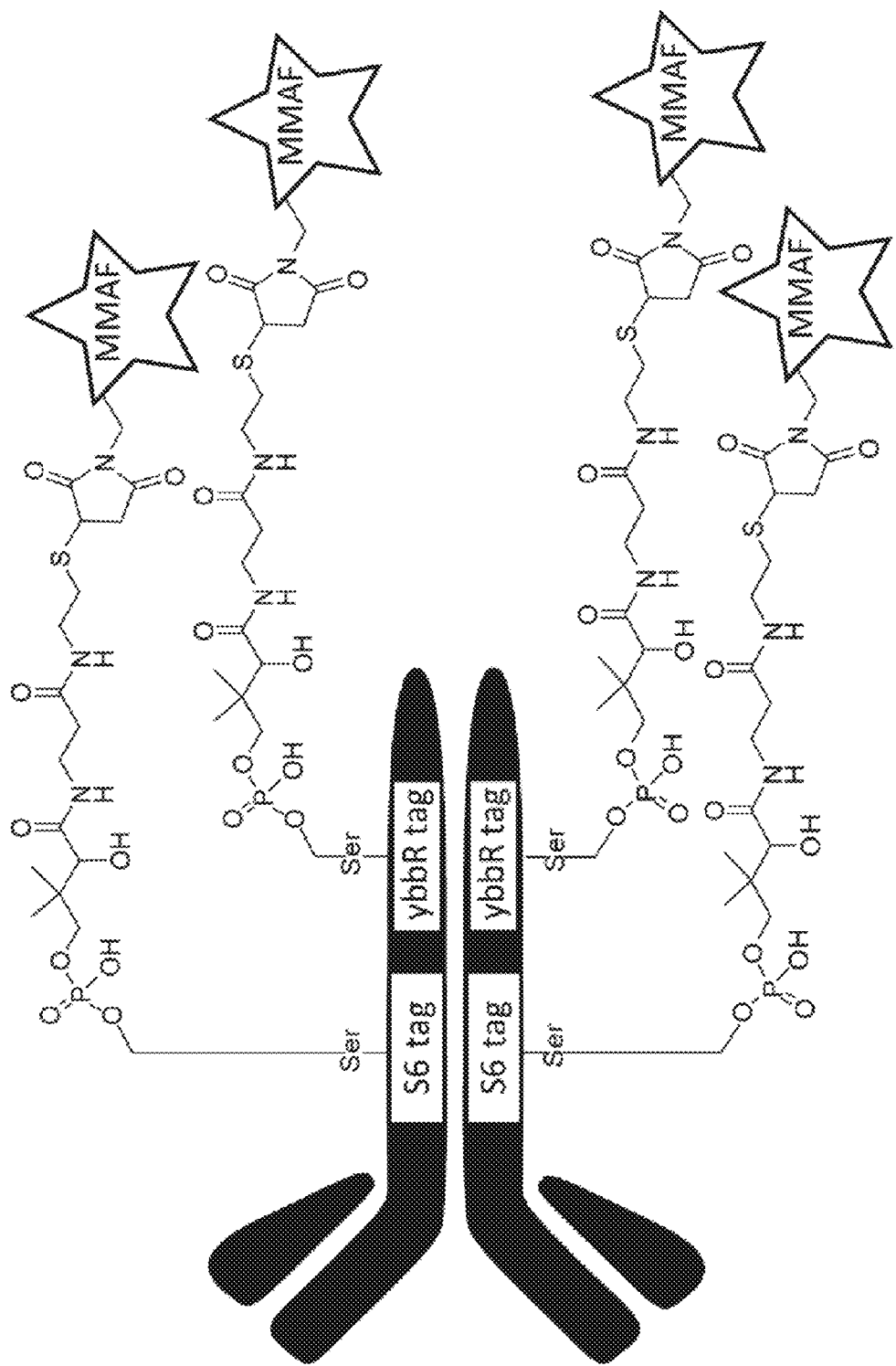

SITE-SPECIFIC LABELING METHODS AND MOLECULES PRODUCED THEREBY

SEQUENCE LISTING

The instant application contains a Sequence Listing which has been submitted in ASCII format via EFS-Web and is hereby incorporated by reference in its entirety. Said ASCII copy, created on Aug. 16, 2013, is named PAT055142-US-NP_SL.txt and is 1,746,131 bytes in size.

FIELD OF THE INVENTION

The present invention relates to site-specific labeling process and molecules produced thereby.

BACKGROUND

Conjugation has been widely used to optimize the properties of biologically active proteins, such as protein therapies, antibody drug conjugates (ADCs), vaccines, tissue selective targeting vehicles, molecular diagnostics, and protein nucleic acid conjugates. Traditional conjugation method utilizes lysine based covalent ligation, which makes it difficult to achieve homogeneity due to the abundance of lysines on the protein's surface.

Site-specific labeling of proteins can be achieved by post-translational enzymatic reactions, for example, using human $O^6$-alkylguanine-DNA alkyl-transferase (AGT), biotin ligase, transglutaminase, sortase, cutinase, or 4'-phosphopantetheinyl transferases for the covalent attachment of a label to a protein.

For post-translational enzymatic reactions using human $O^6$-alkylguanine-DNA alkyl-transferase, the AGT is fused to a target protein of interest, followed by the addition of a labeled $O^6$-benzylguanine, which is a suicide substrate for the AGT (Keppler et al., Nat. Biotechnol. 21:86-89, 2003). This approach is the basis for a technology called SNAP-Tag™, which utilizes a 180 amino acid tag (Tirat et al., International Journal of Biological Macromolecules, 39:66-76, 2006). However, labeling of proteins using this approach occurs only at the C- or N-termini.

For biotin ligation, the enzyme biotin protein ligase (BPL) attaches biotin to the biotin carrier domain of certain carboxylases or decarboxylases. BPL catalyzes, in a two-step, adenosine-5'-triphosphate (ATP)-dependent reaction, the post-translational formation of an amide bond between the carboxyl group of biotin and the ϵ-amino group of a specific lysine residue located within a highly conserved Ala-Met-Lys-Met (SEQ ID NO: 1017) recognition located motif within the biotin carrier domain (Tirat et al., International Journal of Biological Macromolecules, 39:66-76, 2006). This approach can be used to create fusion tags at the C-terminus, the N-terminus or even within the target protein and is the basis for a technology called BioEase™ (72 amino acid tag) and AviTag™ (uses the biotin ligase, BirA and 15-residue acceptor peptide tag (AP)).

Transglutaminases catalyze the formation of stable isopeptidic bonds between the side chains of glutamine (Gln) and lysine (Lys) with the loss of ammonia, and have been used to label glutamine side chains in proteins with fluorophores in vitro (Sato et al., Biochemistry 35:13072-13080, 1996). Also, bacterial and human tissue transglutaminases (BTGase and TG2) have been used to catalyze the post-translational modification of different IgG's via the Lys or Gln side chains located in the IgG heavy chain (Mindt et a, Bioconjugate Chem. 19:271-278, 2008; Jeger et at, Angew. Chem. Int. 49:9995-9997, 2010).

Sortases have been used for C-terminal and N-terminal site specific modification of proteins, where sortase A catalyzes the transpeptidation reaction (Antos et al., JACS, 131:10800-10801, 2009).

Cutinase is a 22-kDa serine esterase that forms a site-specific covalent adduct with phosphonate ligands that is resistant to hydrolysis. Cutinases have been used for C-terminal and N-terminal site specific modification of antibodies followed by immobilization onto surfaces (Kwon et al., Anal. Chem. 76:5713-5720, 2004; Hodneland et al., Proc. Natl. Acad. Sci. U.S.A., 99:5048-5052, 2002).

4'-Phosphopantetheinylation of acyl carrier proteins (ACPs) and peptidyl carrier proteins (PCPs) are involved in an essential post-translational modification that is required to activate metabolite synthesis by polyketide synthases (PKSs) and nonribosomal peptide synthetases (NRPSs), respectively (Fischbach et al., Chem. Rev. 106(8):3468-3496, 2006). The apo to holo conversion of ACPs and PCPs is catalyzed by 4'-phosphopantetheine (ppan) transferases, which attach a 4'-phospho-pantetheinyl moiety of coenzyme A (CoA) to an invariant serine residue of the protein domains (Lambalot et al., Chem. Biol. 3(11):923-936, 1996). Due to the comparably small size of the carrier proteins and the ability of 4'-phosphopantetheinyl transferases to accept functionalized CoA analogues as substrates, researchers have used carrier proteins as fusion tags to label target proteins with a variety of small molecule probes (see, e.g., La Clair et al., Chem. Biol. 11(2):195-201, 2004; Yin et al., J. Am. Chem. Soc. 126(25):7754-7755, 2004). In an effort to further reduce the carrier protein tag size, Walsh and co-workers used phage display to identify 8- to 12-residue peptides that are recognized as efficient substrates by the bacterial 4'-phosphopantetheinyl transferase Sfp (previously identified as a genetic locus responsible for surfactin production) and AcpS (Yin et al., Proc. Natl. Acad. Sci. USA 102(44):15815-15820, 2005; Zhou et al., ACS Chem. Biol. 2(5):337-346, 2007; Zhou et al., J. Am. Chem. Soc. 130(30):9925-9930, 2008).

Antibody drug conjugates (ADCs) have been used for the local delivery of cytotoxic agents in the treatment of cancer (see e.g., Lambert, Curr. Opinion In Pharmacology 5:543-549, 2005). ADCs allow targeted delivery of the drug moiety where maximum efficacy with minimal toxicity may be achieved. As more ADCs show promising clinical results, there is an increased need to develop stable engineered antibodies that provide reactive groups capable of conjugation to various agents, especially site-specific conjugations that can generate homogeneous immunoconjugates with a defined drug-to-antibody ratio for use in cancer therapy.

SUMMARY

The present invention provides modified antibodies or an antigen binding fragments thereof, which comprise at least one peptide tag that is a substrate of 4'-phosphopantetheinyl transferase, and is located within the structural loop of said antibodies or antigen binding fragments. The present invention further provides immunoconjugates comprising such modified antibodies or antigen binding fragments, and a terminal group. The present invention also provides methods of making such modified antibodies, antigen binding fragments, and the immunoconjugates, as well as methods of using such compositions.

In some embodiments, the present invention provides modified antibodies or an antigen binding fragments thereof, which comprise at least one peptide tag that is a substrate of 4'-phosphopantetheinyl transferase, and is located within the structural loop of said antibodies or antigen binding fragments, and wherein the 4'-phosphopantetheinyl transferase is Sfp, AcpS, *T. maritima* PPTase, human PPTase or a mutant or homolog form thereof that retains the 4'-phosphopantetheinyl transferase activity. In some embodiments, the peptide tag is selected from the group consisting of: GDSLSWLLRLLN (SEQ ID NO: 1), GDSLSWL (SEQ ID NO: 2), GDSLSWLVRCLN (SEQ ID NO: 3), GDSLSWLLRCLN (SEQ ID NO: 4), GDSLSWLVRLLN (SEQ ID NO: 5), GDSLSWLLRSLN (SEQ ID NO: 6), GSQDVLDSLEFIASKLA (SEQ ID NO: 7), VLDSLEFIASKLA (SEQ ID NO: 8), DSLEFIASKLA (SEQ ID NO: 9), GDSLDMLEWSLM (SEQ ID NO: 10), GDSLDMLEWSL (SEQ ID NO: 11), GDSLDMLEWS (SEQ ID NO: 12), GDSLDMLEW (SEQ ID NO: 13), DSLDMLEW (SEQ ID NO: 14), GDSLDM (SEQ ID NO: 15), LDSVRMMALAAR (SEQ ID NO: 16), LDSLDMLEWSLR (SEQ ID NO: 17), DSLEFIASKL (SEQ ID NO: 18), DSLEFIASK (SEQ ID NO: 19), DVLDSLEFI (SEQ ID NO: 20), and VLDSLEFIAS (SEQ ID NO: 21). The present invention further provides immunoconjugates comprising such modified antibodies or antigen binding fragments thereof.

In some embodiments, The present invention provides modified antibodies or antigen binding fragments thereof, which comprise at least one peptide tag that is a substrate of 4'-phosphopantetheinyl transferase, and is located within the structural loop of VH, VL, CH1, CH2, CH3, or $C_L$ region of the antibody or antigen binding fragment thereof. In some embodiments, the peptide tag is inserted between any two amino acids that are listed in Table 1. In some embodiments, the present invention provides modified antibodies or antigen binding fragments comprising at least one peptide tag that is a substrate of 4'-phosphopantetheinyl transferase, and is located within the structural loop of the CH1 region of an antibody or antigen binding fragment thereof. The present invention further provides immunoconjugates comprising such modified antibodies or antigen binding fragments thereof.

In some embodiments, the peptide tag is inserted between amino acid residues 2 and 3 of the $V_H$ or $V_L$ domain, or between amino acid residues 63 and 64 of the $V_H$ domain, or between 64 and 65 of the $V_H$ domain, or between 138 and 139 of the CH1 domain, or between 197 and 198 of the CH1 domain, or between 359 and 360 of the CH3 domain, or between 388 and 389 of the CH3 domain, or after 447 of the CH3 domain of a parental antibody or antigen binding fragment thereof. The present invention further provides immunoconjugates comprising such modified antibodies or antigen binding fragments thereof.

In some embodiments, the peptide tag is inserted between amino acid residues 2 and 3 of the VH or VL domain, or between amino acid residue 110 and 111 of the light chain, or between 119 and 120, or between 120 and 121, or between 135 and 136, or between 136 and 137, or between 138 and 139, or between 164 and 165, or between 165 and 166, or between 194 and 195 of the CH1 domain, or between 388 and 389, or between 445 and 446, or between 446 and 447 of the CH3 domain of a parental antibody or antigen binding fragment thereof. The present invention further provides immunoconjugates comprising such modified antibodies or antigen binding fragments thereof.

In some embodiments, the peptide tag is inserted between amino acid residue 110 and 111 of the light chain, or between 119 and 120, or between 120 and 121, or between 135 and 136, or between 136 and 137, or between 138 and 139, or between 165 and 166 of the CH1 domain, or between 388 and 389 of the CH3 domain of a parental antibody or antigen binding fragment thereof. The present invention further provides immunoconjugates comprising such modified antibodies or antigen binding fragments thereof.

In some embodiments, the peptide tag is grafted between amino acid residues 62 to 64 or 62 to 65 of the $V_H$ domain, or between amino acid residues 133 and 138 of the CH1 domain, or between 189 and 195 of the CH1 domain, or between 190 and 197 of the CH1 domain. The present invention further provides immunoconjugates comprising such modified antibodies or antigen binding fragments thereof.

In some embodiments, the present invention provides modified antibodies or an antigen binding fragments comprising SEQ ID NO: 103, SEQ ID NO: 109, SEQ ID NO:113, SEQ ID NO:121, SEQ ID NO:122, SEQ ID NO:127, SEQ ID NO:129, SEQ ID NO:130, SEQ ID NO:131, and/or SEQ ID NO:141. The present invention further provides immunoconjugates comprising such modified antibodies or antigen binding fragments thereof.

In some embodiments, the present invention provides modified antibodies or antigen binding fragments comprising SEQ ID NO:26, SEQ ID NO:27, SEQ ID NO:32, SEQ ID NO:63, SEQ ID NO:94, SEQ ID NO:95, SEQ ID NO:96, SEQ ID NO:126, SEQ ID NO:127, SEQ ID NO:129, SEQ ID NO:130, SEQ ID NO:131, SEQ ID NO:132, SEQ ID NO:139, SEQ ID NO:149, SEQ ID NO:151, SEQ ID NO:152, SEQ ID NO:157, SEQ ID NO:158, SEQ ID NO:160, SEQ ID NO:168, SEQ ID NO:169, SEQ ID NO:178, SEQ ID NO:248, SEQ ID NO:250, SEQ ID NO:251, SEQ ID NO:256, SEQ ID NO:257, SEQ ID NO:259, SEQ ID NO:267, SEQ ID NO:268, SEQ ID NO:277, SEQ ID NO:348, SEQ ID NO:349, SEQ ID NO:356, SEQ ID NO:358, SEQ ID NO:359, SEQ ID NO:364, SEQ ID NO:365, SEQ ID NO:367, SEQ ID NO:373, SEQ ID NO:374, SEQ ID NO:380, SEQ ID NO:384, SEQ ID NO:386, SEQ ID NO:387, or SEQ ID NO:388. The present invention further provides immunoconjugates comprising such modified antibodies or antigen binding fragments thereof.

In some embodiments, the present invention provides modified antibodies or antigen binding fragments comprising SEQ ID NO:32, SEQ ID NO:63, SEQ ID NO:127, SEQ ID NO:129, SEQ ID NO:132, SEQ ID NO:151, SEQ ID NO:152, SEQ ID NO:157, SEQ ID NO:158, SEQ ID NO:160, SEQ ID NO:169, SEQ ID NO:250, SEQ ID NO:251, SEQ ID NO:256, SEQ ID NO:257, SEQ ID NO:259, SEQ ID NO:268, SEQ ID NO:358, SEQ ID NO:359, SEQ ID NO:364, SEQ ID NO:365, SEQ ID NO:367, SEQ ID NO:374, or SEQ ID NO:384. The present invention further provides immunoconjugates comprising such modified antibodies or antigen binding fragments thereof.

In one embodiment, the present invention provides modified antibodies or an antigen binding fragments thereof, which comprise at least one peptide tag that is a substrate of Sfp, and is located within the structural loop of said antibodies or antigen binding fragments, and wherein the peptide tag is GDSLSWLLRLLN (SEQ ID NO:1), GDSLSWLVRCLN (SEQ ID NO:3), GDSLSWLLRCLN (SEQ ID NO:4), GDSLSWLVRLLN (SEQ ID NO:5), GDSLSWLLRSLN (SEQ ID NO:6), GSQDVLDSLEFIASKLA (SEQ ID NO:7), VLDSLEFIASKLA (SEQ ID NO:8), DSLEFIASKLA (SEQ ID NO:9), GDSLDMLEWSLM (SEQ ID NO:10), GDSLDMLEWSL (SEQ ID NO:11), GDSLDMLEWS (SEQ ID NO:12), GDSLDM- LEW (SEQ ID NO:13), DSLDMLEW (SEQ ID NO:14), LDSLDMLEWSLR (SEQ ID NO:17), DSLEFIASKL (SEQ ID NO:18), DSLEFIASK (SEQ ID NO:19), or DSLEFIAS (SEQ ID NO:1116). In another embodiment, the peptide tag is GDSLSWLLRLLN (SEQ ID NO:1), GDSLSWL (SEQ ID NO:2), DSLEFIASKLA (SEQ ID NO:9), GDSLDMLEWSLM (SEQ ID NO:10), DSLEFIASKL (SEQ ID NO:18), or DSLEFIASK (SEQ ID NO:19). The present invention further provides immunoconjugates comprising such modified antibodies or antigen binding fragments thereof.

In some embodiments, the modified antibodies or antigen binding fragments of the invention are an isotype selected from IgG, IgM, IgE and IgA. In some other embodiments, the modified antibodies or antigen binding fragments of the invention are a subtype of IgG selected from IgG1, IgG2, IgG3 and IgG4. In some embodiments, the modified antibodies or antigen binding fragments of the invention are a human or humanized antibody or antigen binding fragment. In a specific embodiment, the modified antibody or antigen binding fragment of the invention is an anti-HER2 antibody or anti-HER2 antibody fragment. The present invention further provides immunoconjugates comprising such modified antibodies or antigen binding fragments thereof.

The present invention provides nucleic acids encoding the modified antibodies or antigen binding fragments described herein, and host cells comprising such nucleic acids.

The present invention provides immunoconjugates comprising a modified antibody or an antigen binding fragment thereof, and a terminal group, wherein the modifice antibody or antigen binding fragment comprises at least one peptide tag that is a substrate of 4'-phosphopantetheinyl transferase, and is located within the structural loop of the antibody or antigen binding fragment. In some embodiments, the modified antibody or antigen binding fragment further comprises one or more orthogonal conjugation sites. In a specific embodiment, each orthogonal conjugation site is independently selected from a substrate of Sfp 4'-phosphopantetheinyl transferase, a substrate of AcpS 4'-phosphopantetheinyl transferase, a lysine, a cysteine, a tyrosine, a histidine, a formyl glycine, an unnatural amino acid, pyrrolysine and pyrroline-carboxylysine.

Another aspect provided herein are immunoconjugates comprising a modified antibody or antigen binding fragment, and a terminal group (TG) attached to the peptide tag in the modified antibody or antigen binding fragment by a linker having the structure according to Formula (I-b):

Formula (I-b)

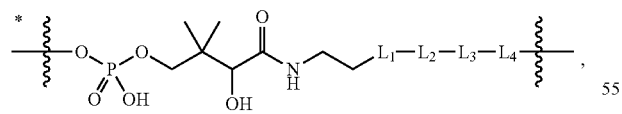

wherein:
  $L_1$ is a bond, a non-enzymatically cleavable linker, a non-cleavable linker; an enzymatically cleavable linker, a photo stable linker or a photo-cleavable linker;
  $L_2$ is a bond, a non-enzymatically cleavable linker, a non-cleavable linker; an enzymatically cleavable linker, a photo stable linker or a photo-cleavable linker;
  $L_3$ is a bond, a non-enzymatically cleavable linker, a non-cleavable linker; an enzymatically cleavable linker, a photo stable linker or a photo-cleavable linker;
  $L_4$ is a bond, a non-enzymatically cleavable linker, a non-cleavable linker; an enzymatically cleavable linker, a photo stable linker, a photo-cleavable linker or a self-immolative spacer,
  the * denotes where the 4'-phosphopantetheinyl moiety is attached to the peptide tag,
  and wherein the terminal group is a drug moiety, an affinity probe, a chelator, a spectroscopic probe, a radioactive probe, an imaging reagent, a lipid molecule, a polyethylene glycol, a polymer, a nanoparticle, a quantum dot, a liposome, a PLGA particle, a polysaccharide, an acetyl group, or a surface.

In certain embodiments of such immunoconjugates:
  $L_1$ is $-A_1X^2-$ or $-X^2-$; $L_2$ is a bond, $-A_2-$, or $-A_2X^2-$;
  $L_3$ is a bond, $-A_3-$, or $-A_3X^2-$;
  $L_4$ is a bond, $-A_4-$, $-A_4X^2-$,

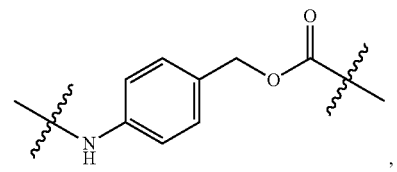
,
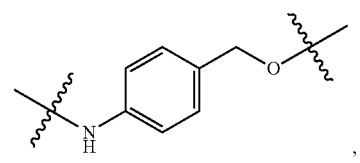
,
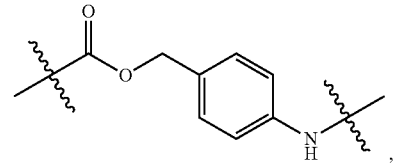
,
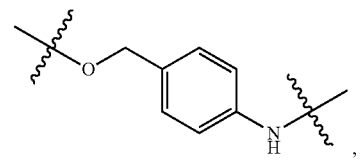
,
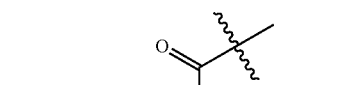
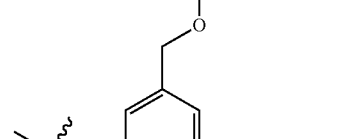
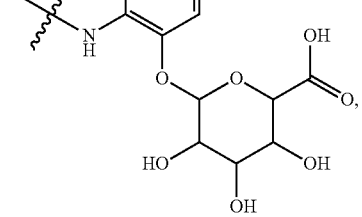
,

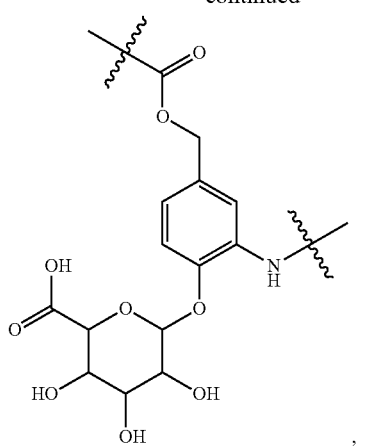,

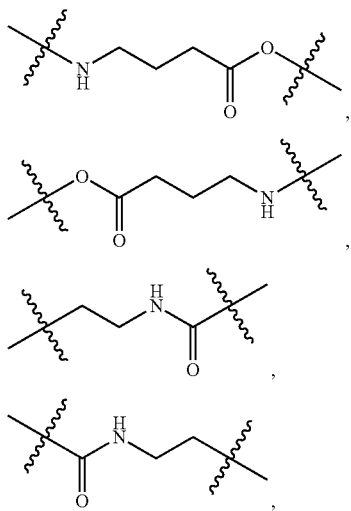,

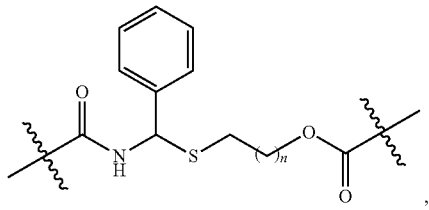,

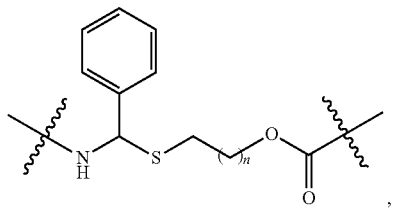,

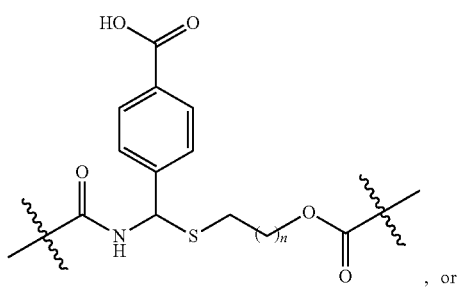, or

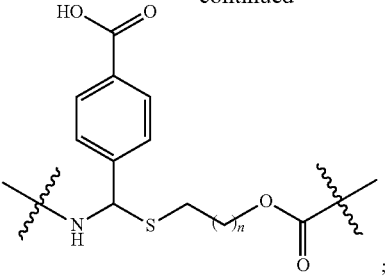;

$A_1$ is —C(=O)NH—, —NHC(=O)—, —C(=O)NH(CH$_2$)$_n$—, —C(=O)NH(C(R$^4$)$_2$)$_n$—, —(O(CH$_2$)$_n$)$_m$—, —(O(C(R$^4$)$_2$)$_n$)$_m$—, —((CH$_2$)$_n$O)$_m$—, —(((C(R$^4$)$_2$)$_n$O)$_m$—, —((CH$_2$)$_n$O)$_m$(CH$_2$)$_n$—, —(((C(R$^4$)$_2$)$_n$O)$_m$C(R$^4$)$_2$)$_n$—, —(CH$_2$)$_n$C(=O)NH—, —(C(R$^4$)$_2$)$_n$C(=O)NH—, —(CH$_2$)$_n$NHC(=O)—, —(C(R$^4$)$_2$)$_n$NHC(=O)—, —NHC(=O)(CH$_2$)$_n$—, —NHC(=O)(C(R$^4$)$_2$)$_n$—, —C(=O)NH(CH$_2$)$_n$S—, —C(=O)NH(C(R$^4$)$_2$)$_n$S—, —S(CH$_2$)$_n$C(=O)NH—, —S(C(R$^4$)$_2$)$_n$C(=O)NH—, —C(=O)NH(CH$_2$)$_n$NHC(=O)(CH$_2$)$_n$—, —C(=O)NH(C(R$^4$)$_2$)$_n$NHC(=O)(C(R$^4$)$_2$)$_n$—, —C(=O)(CH$_2$)$_n$—, —C(=O)(C(R$^4$)$_2$)$_n$—, —(CH$_2$)$_n$C(=O)—, —(C(R$^4$)$_2$)$_n$C(=O)—, —(CH$_2$)$_n$(O(CH$_2$)$_n$)$_m$NHC(=O)(CH$_2$)$_n$—, —(C(R$^4$)$_2$)$_n$(O(C(R$^4$)$_2$)$_n$)$_m$NHC(=O)(C(R$^4$)$_2$)$_n$—, —(CH$_2$)$_n$NHC(=O)(CH$_2$)$_n$—, —(C(R$^4$)$_2$)$_n$NHC(=O)(C(R$^4$)$_2$)$_n$—, —(CH$_2$)$_n$NH((CH$_2$)$_n$O)$_m$(CH$_2$)$_n$—, —(C(R$^4$)$_2$)$_n$NH((C(R$^4$)$_2$)$_n$O)$_m$(C(R$^4$)$_2$)$_n$—, —(O(CH$_2$)$_n$)$_m$NHC(=O)(CH$_2$)$_n$—, or —(O(C(R$^4$)$_2$)$_n$)$_m$NHC(=O)(C(R$^4$)$_2$)$_n$—;

$A_2$ is —C(=O)NH—, —C(=O)NH(CH$_2$)$_n$—, —C(=O)NH(C(R$^4$)$_2$)$_n$—, —(O(CH$_2$)$_n$)$_m$—, —(O(C(R$^4$)$_2$)$_n$)$_m$—, —((CH$_2$)$_n$O)$_m$—, —(((C(R$^4$)$_2$)$_n$O)$_m$—, —((CH$_2$)$_n$O)$_m$(CH$_2$)$_n$—, —(((C(R$^4$)$_2$)$_n$O)$_m$C(R$^4$)$_2$)$_n$—, —(CH$_2$)$_n$C(=O)NH—, —(C(R$^4$)$_2$)$_n$C(=O)NR$^4$—, —(CH$_2$)$_n$NHC(=O)—, —(C(R$^4$)$_2$)$_n$NHC(=O)—, —NHC(=O)(CH$_2$)$_n$—, —NHC(=O)(C(R$^4$)$_2$)$_n$—, —C(=O)NH(CH$_2$)$_n$S—, —C(=O)NH(C(R$^4$)$_2$)$_n$S—, —S(CH$_2$)$_n$C(=O)NH—, —S(C(R$^4$)$_2$)$_n$C(=O)NH—, —(CH$_2$)$_n$S—, —(C(R$^4$)$_2$)$_n$S—, —S(CH$_2$)$_n$—, —S(C(R$^4$)$_2$)$_n$—, —(CH$_2$)$_n$NH—, —(C(R$^4$)$_2$)$_n$NH—, —C(=O)NH(CH$_2$)$_n$NHC(=O)(CH$_2$)$_n$—, —C(=O)NH(C(R$^4$)$_2$)$_n$NHC(=O)(C(R$^4$)$_2$)$_n$—, —C(=O)(CH$_2$)$_n$—, —C(=O)(C(R$^4$)$_2$)$_n$—, —(CH$_2$)$_n$C(=O)—, —(C(R$^4$)$_2$)$_n$C(=O)—, —(CH$_2$)$_n$(O(CH$_2$)$_n$)$_m$NHC(=O)(CH$_2$)$_n$—, —(C(R$^4$)$_2$)$_n$(O(C(R$^4$)$_2$)$_n$)$_m$NHC(=O)(C(R$^4$)$_2$)$_n$—, —(CH$_2$)$_n$(CH$_2$)$_n$)$_m$OC(=O)NH(CH$_2$)$_n$—, —(C(R$^4$)$_2$)$_n$(O(C(R$^4$)$_2$)$_n$)$_m$OC(=O)NH(C(R$^4$)$_2$)$_n$—, —(CH$_2$)$_n$NHC(=O)(CH$_2$)$_n$—, —(C(R$^4$)$_2$)$_n$NHC(=O)(C(R$^4$)$_2$)$_n$—, —(CH$_2$)$_n$NH((CH$_2$)$_n$O)$_m$(CH$_2$)$_n$—, —(C(R$^4$)$_2$)$_n$NH((C(R$^4$)$_2$)$_n$O)$_m$(C(R$^4$)$_2$)$_n$—, —(O(CH$_2$)$_n$)$_m$NHC(=O)(CH$_2$)$_n$—, —(O(C(R$^4$)$_2$)$_n$)$_m$NHC(=O)(C(R$^4$)$_2$)$_n$—,

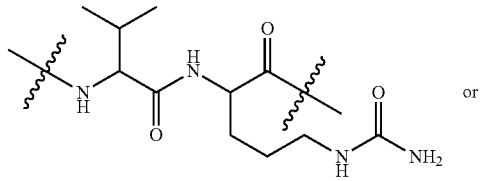 or

-continued

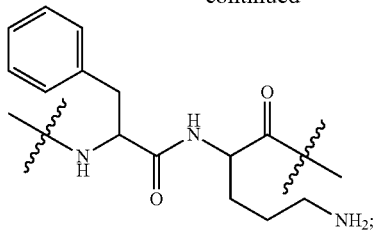

A₃ is —C(=O)NH—, —C(=O)NH(CH₂)$_n$—, —C(=O)NH(C(R⁴)₂)$_n$—, —(O(CH₂)$_n$)$_m$—, —(O(C(R⁴)₂)$_n$)$_m$—, —((CH₂)$_n$O)$_m$—, —(((C(R⁴)₂)$_n$O)$_m$—, —((CH₂)$_n$O)$_m$(CH₂)$_n$—, —(((C(R⁴)₂)$_n$O)$_m$C(R⁴)₂)$_n$—, —(CH₂)$_n$C(=O)NH—, —(C(R⁴)₂)$_n$C(=O)NH—, —(CH₂)$_n$NHC(=O)—, —(C(R⁴)₂)$_n$NHC(=O)—, —NHC(=O)(CH₂)$_n$—, —NHC(=O)(C(R⁴)₂)$_n$—, —C(=O)NH(CH₂)$_n$S—, —C(=O)NH(C(R⁴)₂)$_n$S—, —S(CH₂)$_n$C(=O)NH—, —S(C(R⁴)₂)$_n$C(=O)NH—, —(CH₂)$_n$S—, —(C(R⁴)₂)$_n$S—, —S(CH₂)$_n$—, —S(C(R⁴)₂)$_n$—, —C(=O)NH(CH₂)$_n$NHC(=O)(CH₂)$_n$—, —C(=O)NH(C(R⁴)₂)$_n$NHC(=O)(C(R⁴)₂)$_n$—, —C(=O)(CH₂)$_n$—, —C(=O)(C(R⁴)₂)$_n$—, —(CH₂)$_n$C(=O)—, —(C(R⁴)₂)$_n$C(=O)—, —(CH₂)$_n$(O(CH₂)$_n$)$_m$NHC(=O)(CH₂)$_n$—, —(C(R⁴)₂)$_n$(O(C(R⁴)₂)$_n$)$_m$NHC(=O)(C(R⁴)₂)$_n$—, —(CH₂)$_n$(OCH₂)$_n$)$_m$OC(=O)NH(CH₂)$_n$—, —(C(R⁴)₂)$_n$(O(C(R⁴)₂)$_n$)$_m$OC(=O)NH(C(R⁴)₂)$_n$—, —(CH₂)$_n$(O(CH₂)$_n$)$_m$OC(=O)—, —(C(R⁴)₂)$_n$(O(C(R⁴)₂)$_n$)$_m$OC(=O)—, —(CH₂)$_n$(O(CH₂)$_n$)$_m$C(=O)—, —(C(R⁴)₂)$_n$(O(C(R⁴)₂)$_n$)$_m$C(=O)—, —(CH₂)$_n$NHC(=O)(CH₂)$_n$—, —(C(R⁴)₂)$_n$NHC(=O)(C(R⁴)₂)$_n$—, —(O(CH₂)$_n$)$_m$NHC(=O)(CH₂)$_n$—, —(O(C(R⁴)₂)$_n$)$_m$NHC(=O)(C(R⁴)₂)$_n$—,

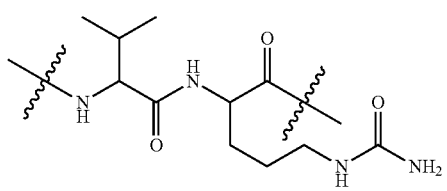

or

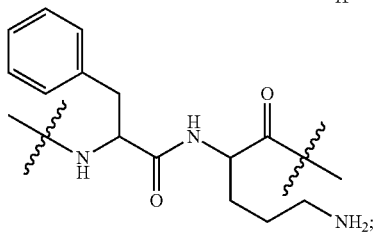

A₄ is —C(=O)NH—, —C(=O)NH(CH₂)$_n$—, —C(=O)NH(C(R⁴)₂)$_n$—, —(O(CH₂)$_n$)$_m$—, —(O(C(R⁴)₂)$_n$)$_m$—, —((CH₂)$_n$O)$_m$—, —(((C(R⁴)₂)$_n$O)$_m$—, —((CH₂)$_n$O)$_m$(CH₂)$_n$—, —(((C(R⁴)₂)$_n$O)$_m$C(R⁴)₂)$_n$—, —(CH₂)$_n$C(=O)NH—, —(C(R⁴)₂)$_n$C(=O)NH—, —(CH₂)$_n$NHC(=O)—, —(C(R⁴)₂)$_n$NHC(=O)—, —NHC(=O)(CH₂)$_n$—, —NHC(=O)(C(R⁴)₂)$_n$—, —C(=O)NH(CH₂)$_n$S—, —C(=O)NH(C(R⁴)₂)$_n$S—, —S(CH₂)$_n$C(=O)NH—, —S(C(R⁴)₂)$_n$C(=O)NH—, —C(=O)NH(CH₂)$_n$NHC(=O)(CH₂)$_n$—, —C(=O)NH(C(R⁴)₂)$_n$NHC(=O)(C(R⁴)₂)$_n$—, —C(=O)(CH₂)$_n$—, —C(=O)(C(R⁴)₂)$_n$—, —(CH₂)$_n$C(=O)—, —(C(R⁴)₂)$_n$C(=O)—, —(CH₂)$_n$(O(CH₂)$_n$)$_m$NHC(=O)(CH₂)$_n$—, —(C(R⁴)₂)$_n$(O(C(R⁴)₂)$_n$)$_m$NHC(=O)(C(R⁴)₂)$_n$—, —(CH₂)$_n$NHC(=O)(CH₂)$_n$—, —(C(R⁴)₂)$_n$NHC(=O)(C(R⁴)₂)$_n$—, —(CH₂)$_n$NH((CH₂)$_n$O)$_m$(CH₂)$_n$—, —(C(R⁴)₂)$_n$NH((C(R⁴)₂)$_n$O)$_m$(C(R⁴)₂)$_n$—, —(O(CH₂)$_n$)$_m$NHC(=O)(CH₂)$_n$—, or —(O(C(R⁴)₂)$_n$)$_m$NHC(=O)(C(R⁴)₂)$_n$—;

each X² is independently selected from a bond,

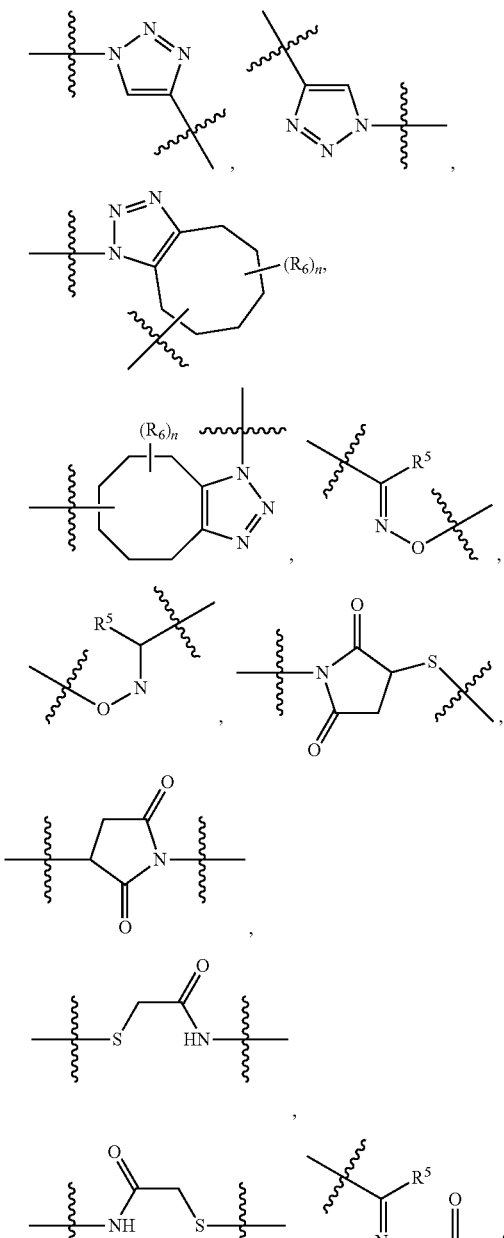

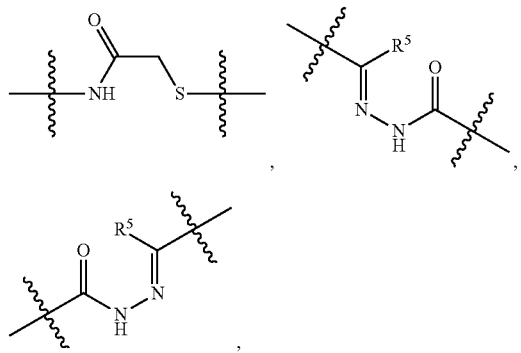

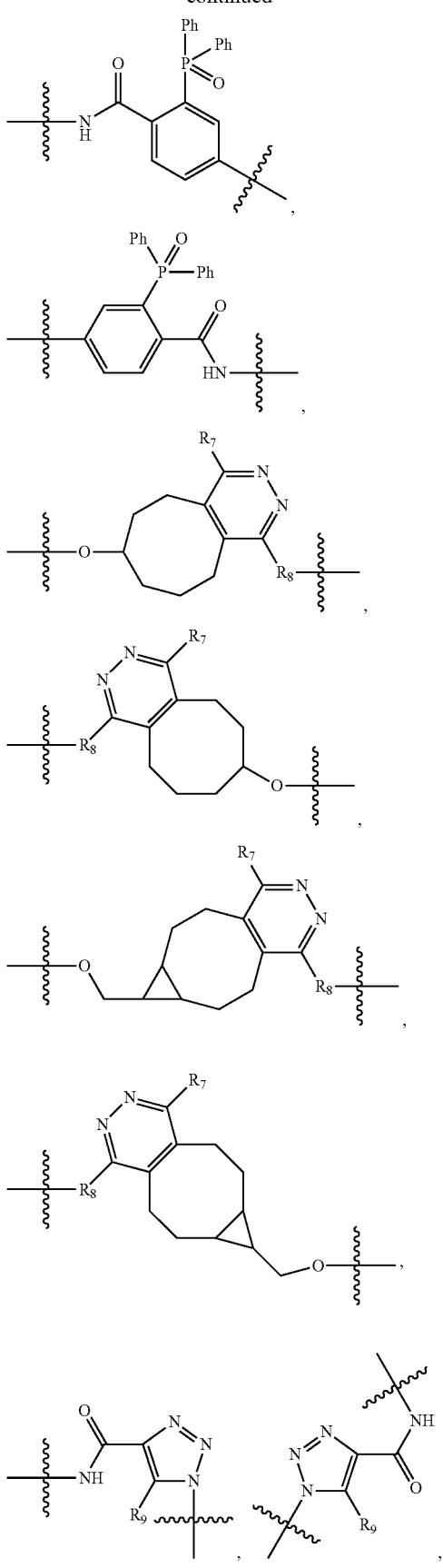

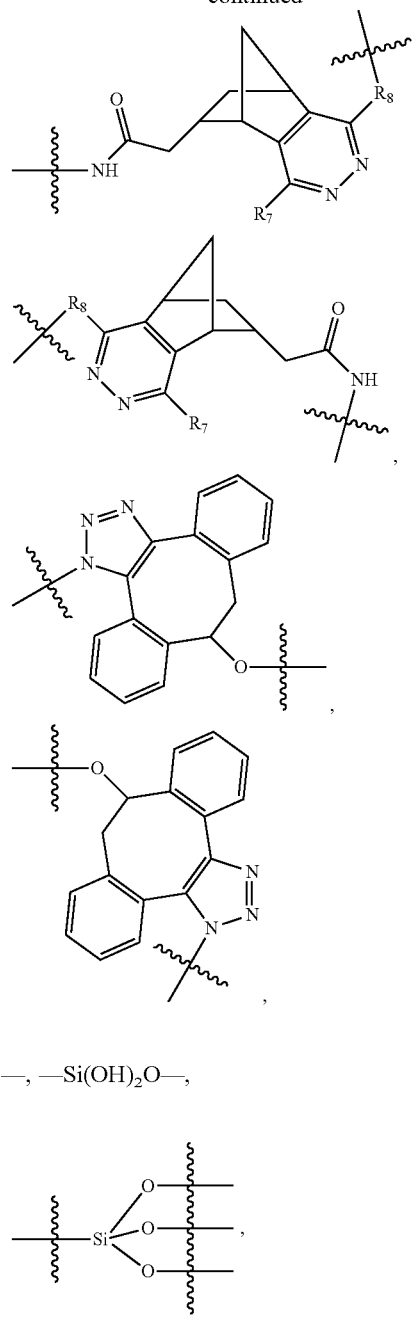

—S—, —Si(OH)$_2$O—,

—CHR$^4$(CH$_2$)$_n$C(=O)NH—, —CHR$^4$(CH$_2$)$_n$NHC(=O)—, —C(=O)NH— and —NHC(=O)—;

each R$^4$ is independently selected from H, C$_{1-4}$alkyl, —C(=O)OH and —OH, each R$^5$ is independently selected from H, C$_{1-4}$alkyl, phenyl or C$_{7-4}$alkyl substituted with 1 to 3 —OH groups;

each R$^6$ is independently selected from H, fluoro, benzyloxy substituted with —C(=O)OH, benzyl substituted with —C(=O)OH, C$_{1-4}$alkoxy substituted with —C(=O)OH and C$_{1-4}$alkyl substituted with —C(=O)OH;

R$^7$ is independently selected from H, phenyl and pyridine;

$R^8$ is independently selected from
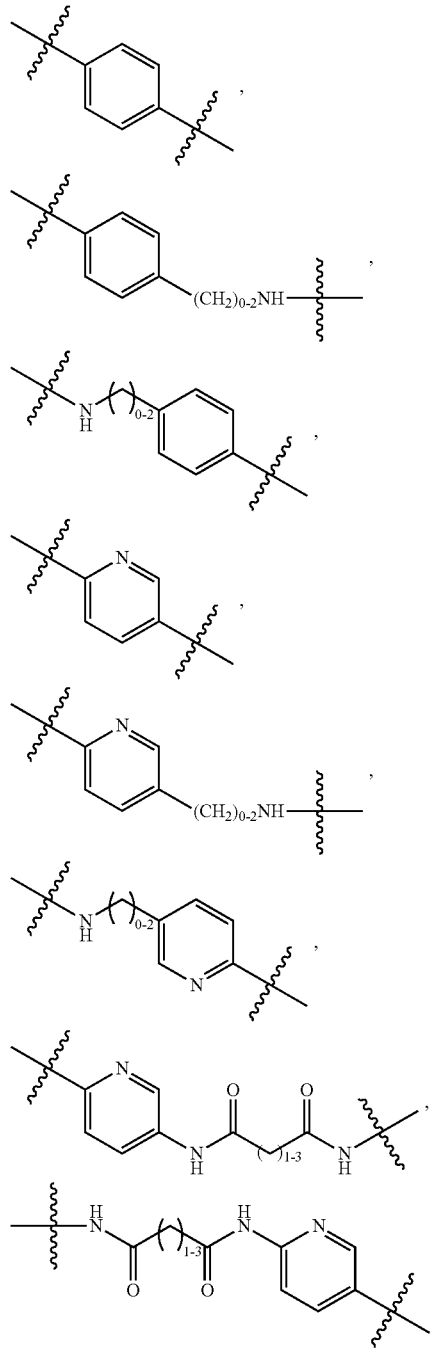
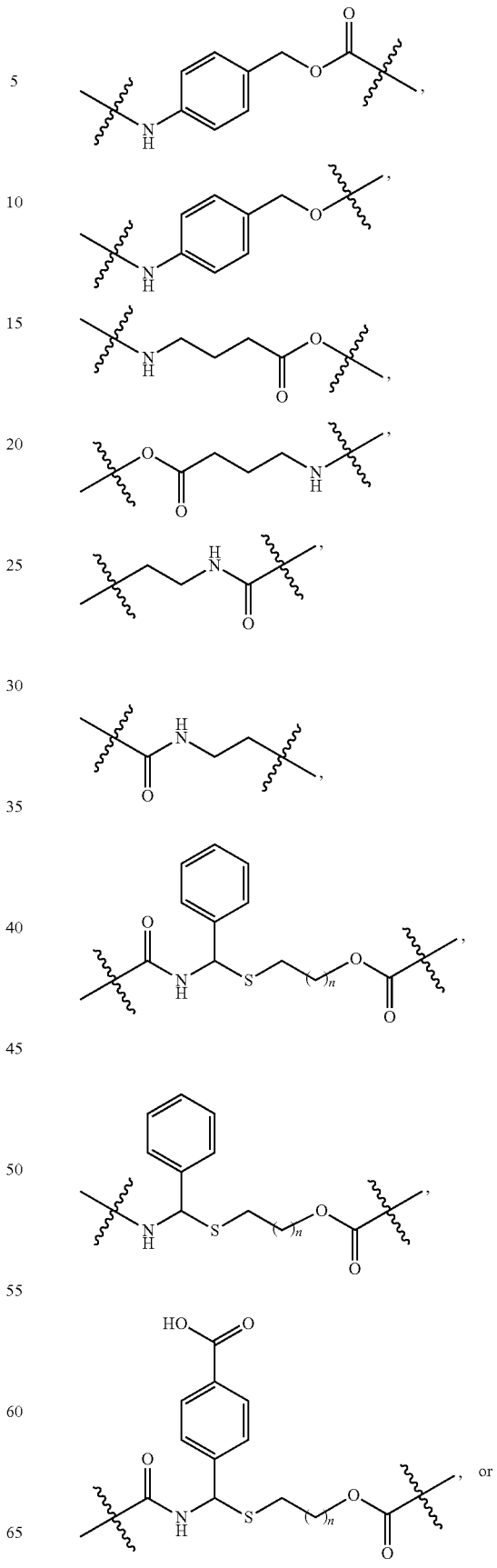
$R^9$ is independently selected from H and $C_{1-6}$haloalkyl;
each n is independently selected from 1, 2, 3, 4, 5, 6, 7, 8 and 9, and
each m is independently selected from 1, 2, 3, 4, 5, 6, 7, 8 and 9.
In other embodiments of such immunoconjugates:
$L_1$ is $-A_1X^2-$ or $-X^2-$;
$L_2$ is a bond, $-A_2-$, or $-A_2X^2-$;
$L_3$ is a bond, $-A_3-$, or $-A_3X^2-$;
$L_4$ is a bond, $-A_4-$, $-A_4X^2-$, -continued

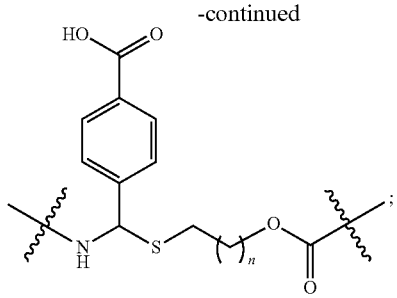

$A_1$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$— or —(O(CH$_2$)$_n$)$_m$NHC(=O)(CH$_2$)$_n$—;

$A_2$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$—, —(O(CH$_2$)$_n$)$_m$NHC(=O)(CH$_2$)$_n$— or

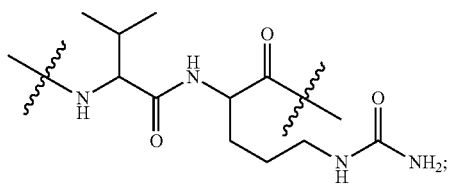 [SMILES: *NC(C(=O)NC(CCCNC(N)=O)C(*)=O)C(C)C]

$A_3$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$—, —(O(CH$_2$)$_n$)$_m$NHC(=O)(CH$_2$)$_n$— or

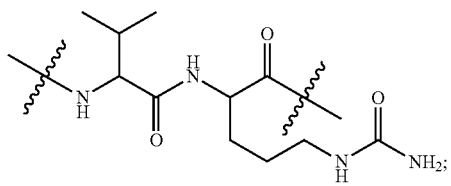 [SMILES: *NC(C(=O)NC(CCCNC(N)=O)C(*)=O)C(C)C]

$A_4$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$— or —(O(CH$_2$)$_n$)$_m$NHC(=O)(CH$_2$)$_n$—;

each $X^2$ is independently selected from a bond,

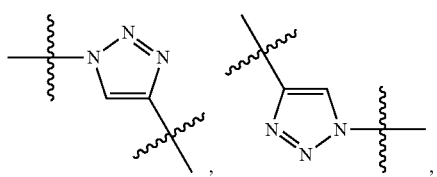

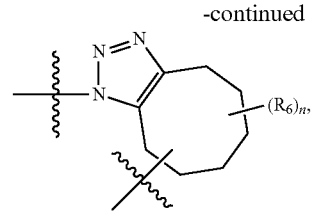

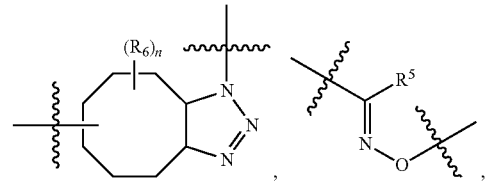

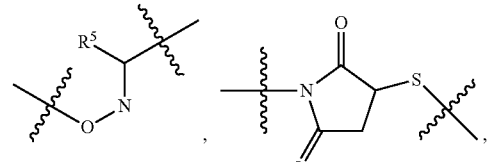

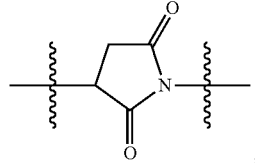

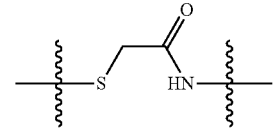

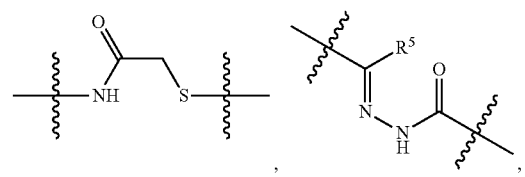

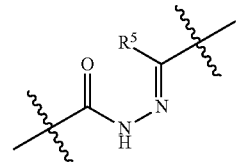

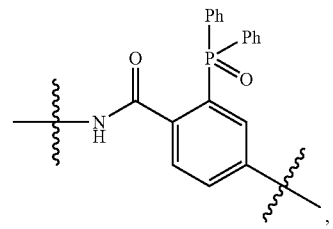

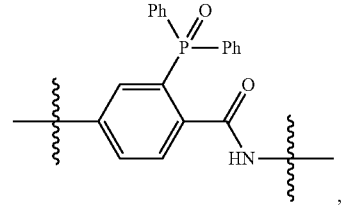

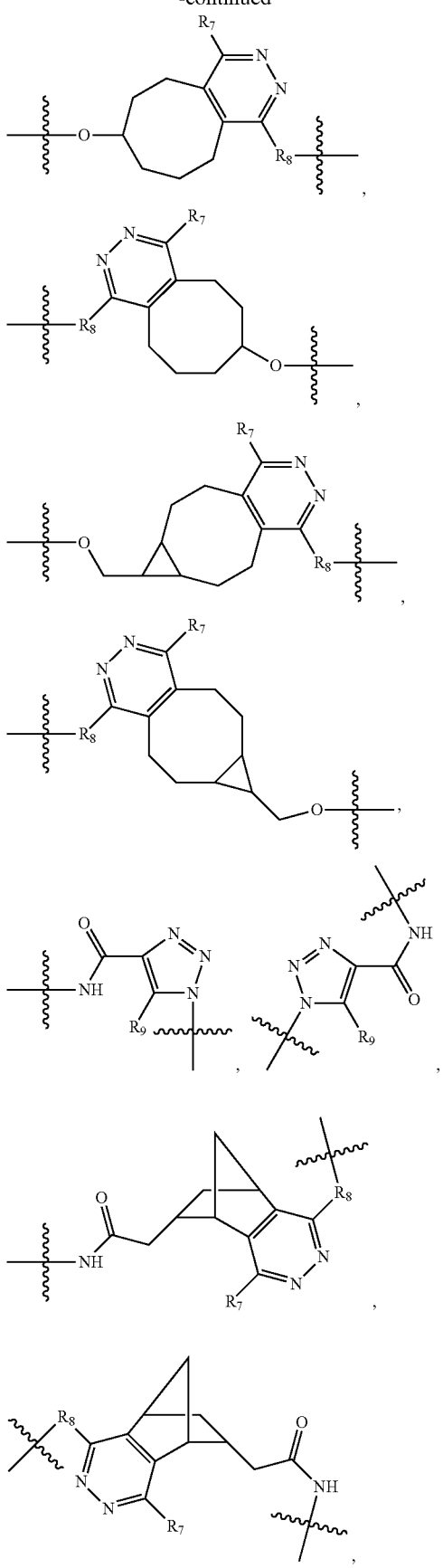

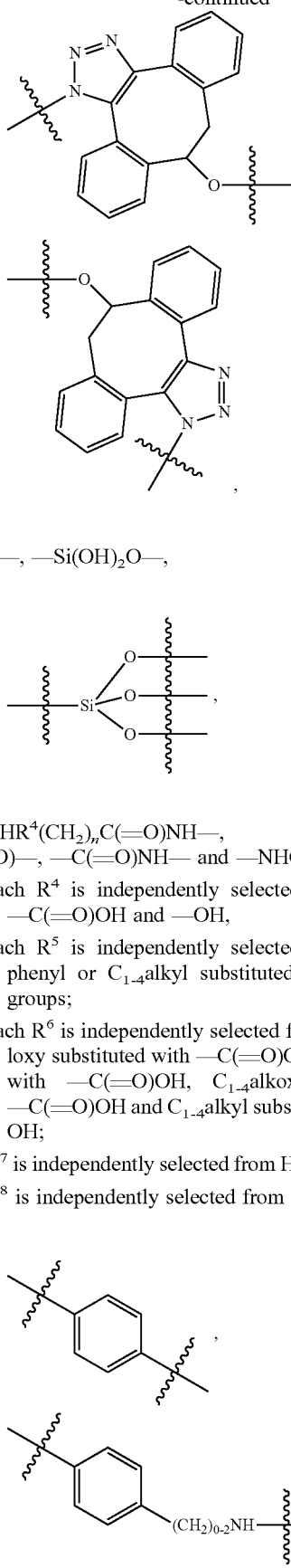

—S—, —Si(OH)₂O—,

—CHR⁴(CH₂)ₙC(=O)NH—, —CHR⁴(CH₂)ₙNHC(=O)—, —C(=O)NH— and —NHC(=O)—;

each $R^4$ is independently selected from H, $C_{1-4}$alkyl, —C(=O)OH and —OH, each $R^5$ is independently selected from H, $C_{1-4}$alkyl, phenyl or $C_{1-4}$alkyl substituted with 1 to 3 —OH groups;

each $R^6$ is independently selected from H, fluoro, benzyloxy substituted with —C(=O)OH, benzyl substituted with —C(=O)OH, $C_{1-4}$alkoxy substituted with —C(=O)OH and $C_{1-4}$alkyl substituted with —C(=O)OH;

$R^7$ is independently selected from H, phenyl and pyridine;

$R^8$ is independently selected from

-continued

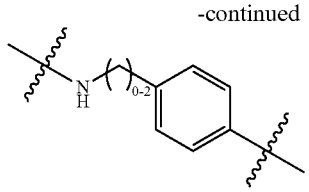

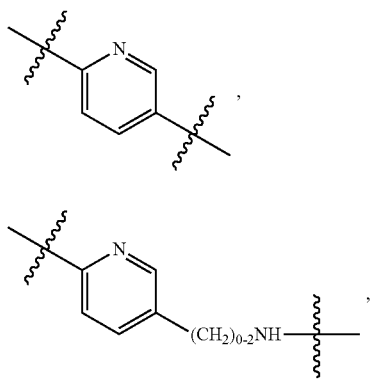

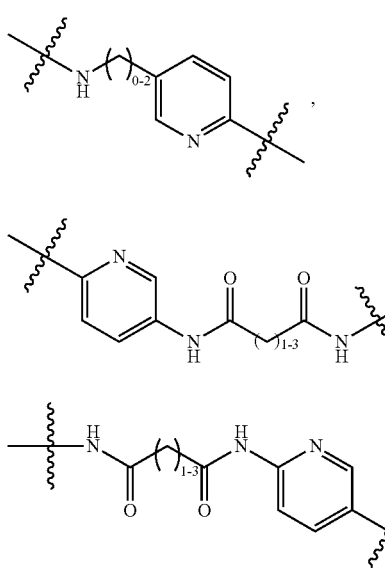

$R^9$ is independently selected from H and $C_{1-6}$haloalkyl;
each n is independently selected from 1, 2, 3, 4, 5, 6, 7, 8 and 9, and
each m is independently selected from 1, 2, 3, 4, 5, 6, 7, 8 and 9.

In certain embodiments of such aforementioned immunoconjugates, the linker of Formula (I-b) is a linker having the structure according to Formula (I-c):

In other embodiments of such aforementioned immunoconjugates:

$L_1$ is -$A_1X^2$—, where $A_1$ is —C(=O)NH(CH$_2$)$_n$S— and $X^2$ is

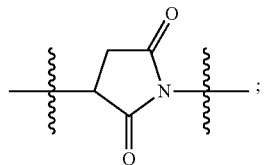 [SMILES: *C1CC(=O)N(*)C1=O]

$L_2$ is a bond; $L_3$ is a bond, and $L_4$ is -$A_4$- wherein $A_4$ is —(CH$_2$)$_n$NHC(=O)—.

In other embodiments of such aforementioned immunoconjugates:

$L_1$ is -$A_1X^2$—, wherein $A_1$ is —C(=O)NH(CH$_2$)$_n$S— and $X^2$ is

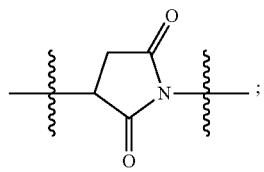 [SMILES: *C1CC(=O)N(*)C1=O]

$L_2$ is a bond; $L_3$ is a bond; $L_4$ is -$A_4$-, wherein $A_4$ is —(CH$_2$)$_n$C(=O)—.

In other embodiments of such immunoconjugates:

$L_1$ is -$A_1X^2$—, wherein $A_1$ is —C(=O)NH(CH$_2$)$_n$S— and $X^2$ is

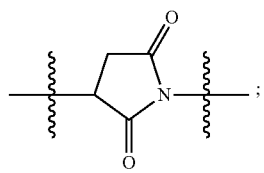 [SMILES: *C1CC(=O)N(*)C1=O]

Formula (I-c)

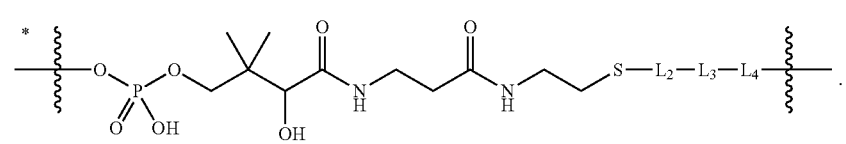

$L_2$ is -$A_2$-, wherein $A_2$ is —$(CH_2)_nC(=O)$;
$L_3$ is -$A_3$-, wherein $A_3$ is

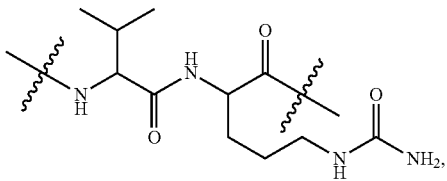 [SMILES: *NC(C(=O)NC(CCCNC(N)=O)C(*)=O)C(C)C]

and
$L_4$ is

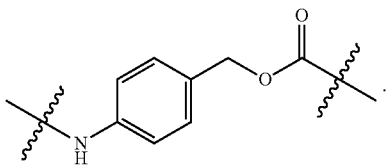 [SMILES: *Nc1ccc(COC(*)=O)cc1]

In other embodiments of such aforementioned immunoconjugates:
$L_1$ is a -$A_1X^2$—, wherein $A_1$ is —$C(=O)NH(CH_2)_nS$— and $X^2$ is —$(CH_2)C(=O)NH$—;
$L_2$ is a bond-; $L_3$ is -$A_3$-, wherein $A_3$ is —$(CH_2)_nC(=O)$—, and $L_4$ is a bond.

In other embodiments of such aforementioned immunoconjugates:
$L_1$ is a -$A_1X^2$—, wherein $A_1$ is —$C(=O)NH(CH_2)_nS$—, $X^2$ is —$CHR^4(CH_2)_nC(=O)NH$— and $R^4$ is —$C(=O)OH$;
$L_2$ is a bond; $L_3$ is -$A_3$-, wherein $A_3$ is —$(CH_2)_nC(=O)$— and. $L_4$ is a bond.

In other embodiments of such aforementioned immunoconjugates:
$L_1$ is -$A_1X^2$—, where $A_1$ is —$C(=O)NH(CH_2)_nS$— and $X^2$ is —$(CH_2)C(=O)NH$—;
$L_2$ is a bond; $L_3$ is a bond, and $L_4$ is -$A_4$- wherein $A_4$ is —$(CH_2)_nNHC(=O)$—.

In other embodiments of such aforementioned immunoconjugates:
$L_1$ is -$A_1X^2$—, wherein $A_1$ is —$C(=O)NH(CH_2)_nS$— and $X^2$ is —$(CH_2)C(=O)NH$—;
$L_2$ is a bond; $L_3$ is a bond; $L_4$ is -$A_4$-, wherein $A_4$ is —$(CH_2)_nC(=O)$—.

In other embodiments of such aforementioned immunoconjugates:
$L_1$ is -$A_1X^2$—, wherein $A_1$ is —$C(=O)NH(CH_2)_nS$— and $X^2$ is —$(CH_2)C(=O)NH$—;
$L_2$ is -$A_2$-, wherein $A_2$ is —$(CH_2)_nC(=O)$;
$L_3$ is -$A_3$-, wherein $A_3$ is

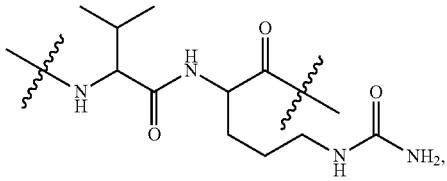 [SMILES: *NC(C(=O)NC(CCCNC(N)=O)C(*)=O)C(C)C]

and
$L_4$ is

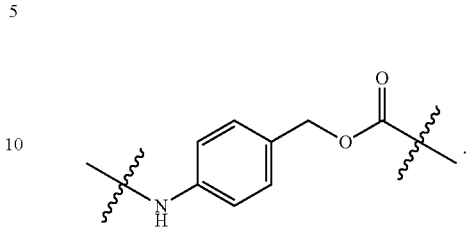

In other embodiments of such aforementioned immunoconjugates:
$L_1$ is a -$A_1X^2$—, wherein $A_1$ is —$C(=O)NH(CH_2)_nS$— and $X^2$ is —$(CH_2)C(=O)NH$—;
$L_2$ is a bond-; $L_3$ is -$A_3$-, wherein $A_3$ is —$(CH_2)_nC(=O)$—, and $L_4$ is a bond.

In other embodiments of such aforementioned immunoconjugates:
$L_1$ is a -$A_1X^2$—, wherein $A_1$ is —$C(=O)NH(CH_2)_nS$—, $X^2$ is —$CHR^4(CH_2)_nC(=O)NH$— and $R^4$ is —$C(=O)OH$;
$L_2$ is a bond; $L_3$ is -$A_3$-, wherein $A_3$ is —$(CH_2)_nC(=O)$— and. $L_4$ is a bond.

In the embodiments of the aforementioned immunoconjugates the terminal group is a drug moiety selected from an anti-inflammatory agent, an anticancer agent, an antifungal agent, an antibacterial agent, an anti-parasitic agent, an anti-viral agent and an anesthetic agent. In certain embodiments of such immunoconjugates the drug moiety is selected from a V-ATPase inhibitor, a HSP90 inhibitor, an IAP inhibitor, an mTor inhibitor, a microtubule stabilizer, a microtubule destabilizers, an auristatin, a dolastatin, a maytansinoid, a MetAP (methionine aminopeptidase), an inhibitor of nuclear export of proteins CRM1, a DPPIV inhibitor, an inhibitors of phosphoryl transfer reactions in mitochondria, a protein synthesis inhibitor, a CDK2 inhibitor, a CDK9 inhibitor, an EG5 inhibitor, an HDAC inhibitor, a DNA damaging agent, a DNA alkylating agent, a DNA intercalator, a DNA minor groove binder, a proteasome inhibitor, and a DHFR inhibitor. In certain embodiments of such immunoconjugates the spectroscopic probe is selected from a fluorophore, a chromophore, a quantum dot, a magnetic probe, a radioactive probe, an imaging reagent, or a contrast reagent. In certain embodiments of such immunoconjugates the affinity probe is biotin.

Another aspect provided herein is the preparation of an immunoconjugate by a process comprising the steps of:
(a) providing a modified antibody or antigen binding fragment thereof, wherein the modified antibody or antigen binding fragment comprises a peptide tag, and wherein the peptide tag is a substrate of an enzyme having phosphopantetheinyl transferase activity, and
(b) labeling the modified antibody or antigen binding fragment with a terminal group by incubating the modified antibody or antigen binding fragment thereof with an enzyme having phosphopantetheinyl transferase activity in the presence of a coenzyme A analog having the structure of Formula B:

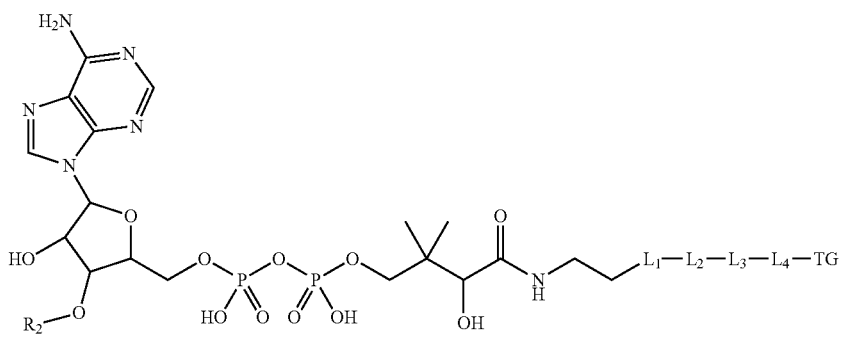
Formula (B)
wherein $L_1$, $L_2$, $L_3$, $L_4$, $R_2$ and TG are as defined herein; thereby the terminal group is attached to the peptide tag by a linker having the structure according to Formula (I-b):
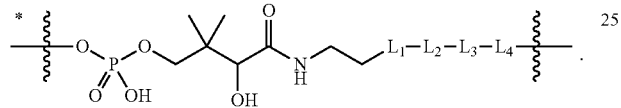
Formula (I-b)
where the * denotes the phosphopantetheinyl moiety is attached to the peptide tag.
In certain embodiments the compound of Formula (B) is selected from
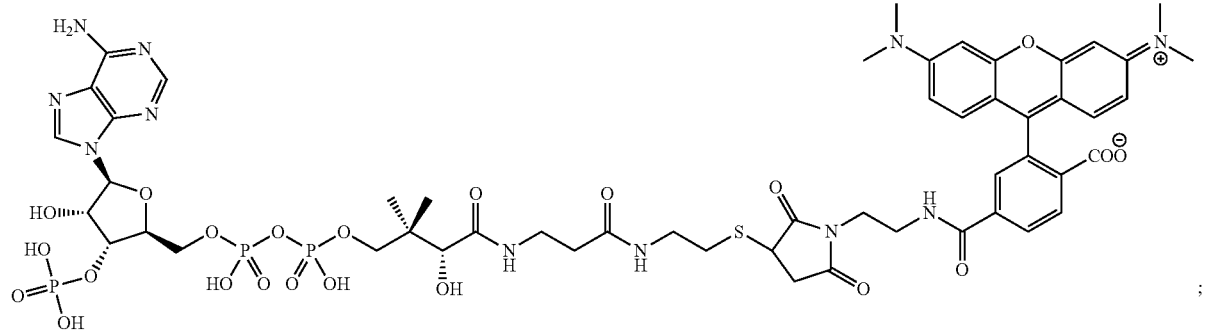
;
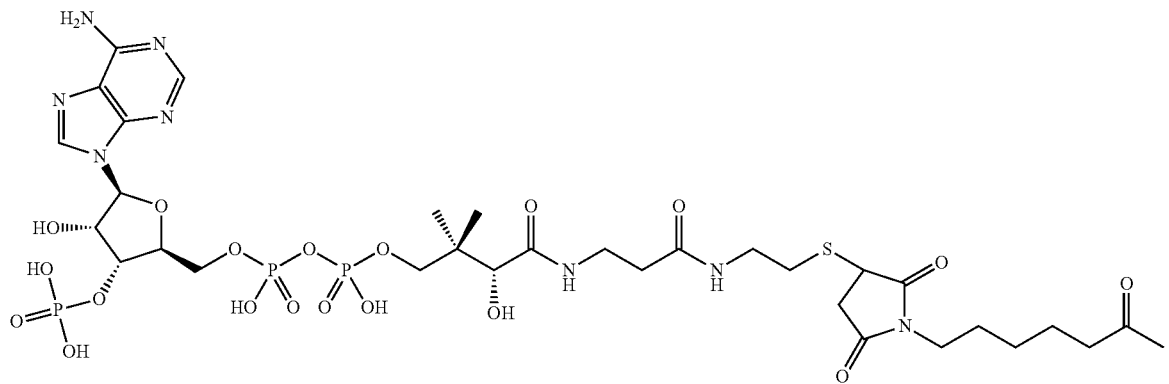

-continued
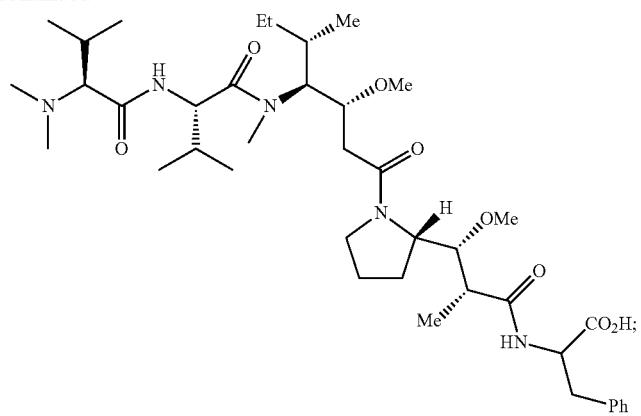
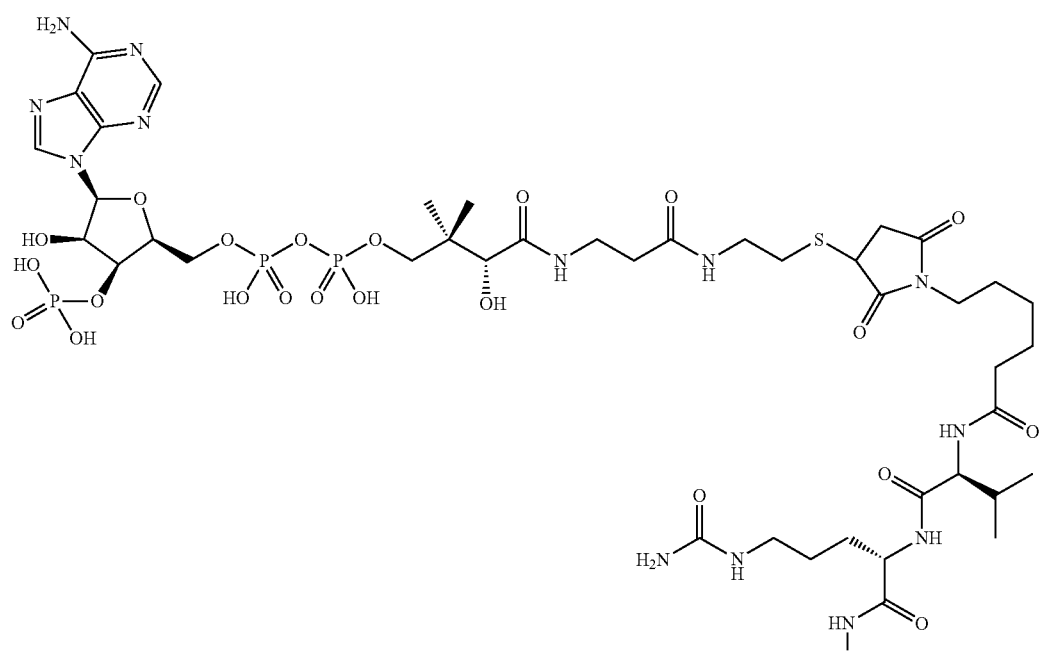
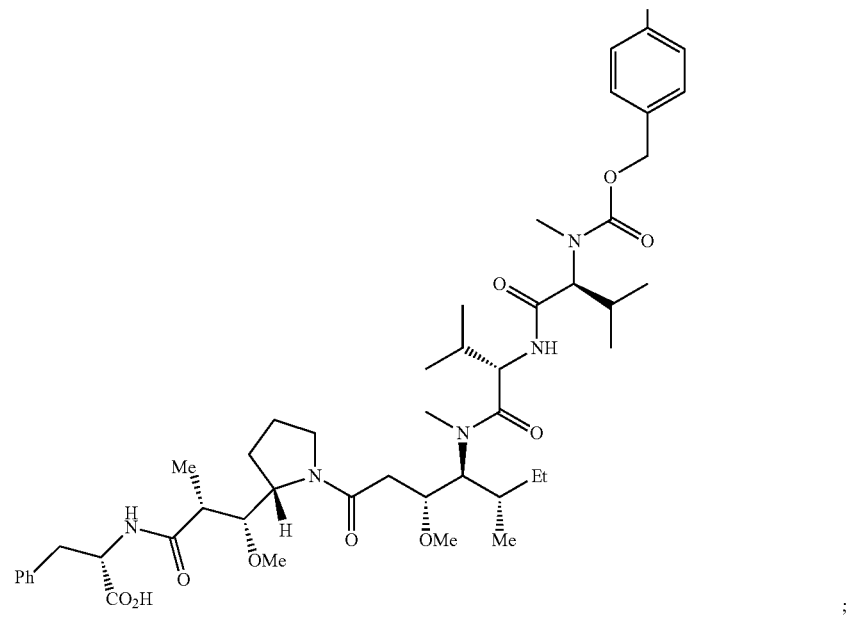

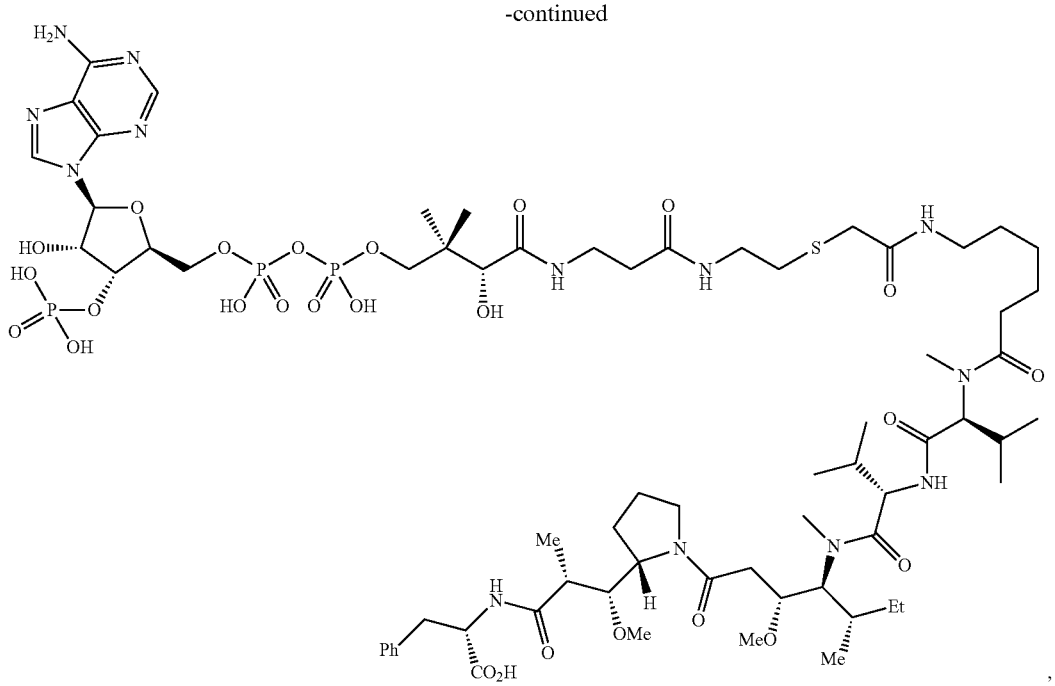

, and

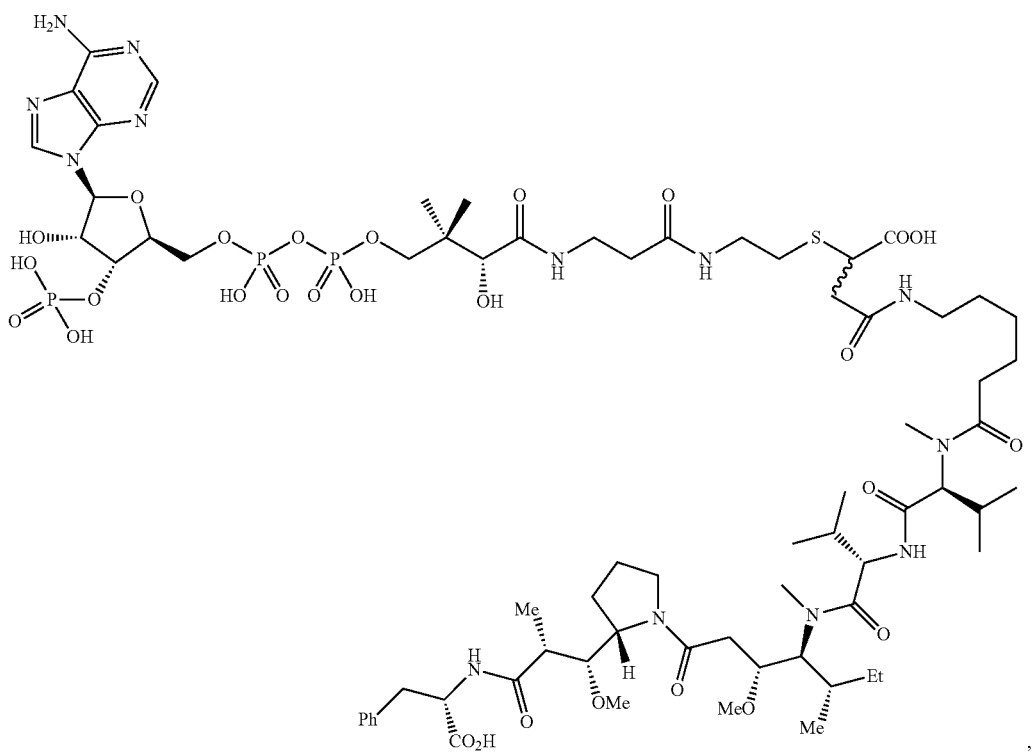

,

Another aspect provided herein is the preparation of an immunoconjugate by a process comprising the steps of:

(a) providing a modified antibody or antigen binding fragment thereof, wherein the a modified antibody or antigen binding fragment thereof, comprises a peptide tag, and wherein the peptide tag is a substrate of an enzyme having phosphopantetheinyl transferase activity;

(b) labeling the modified antibody or antigen binding fragment thereof, with a terminal group (TG) by
i) incubating the modified antibody or antigen binding fragment thereof, with an enzyme having phosphopantetheinyl transferase activity in the presence of a compound of Formula (D), Formula (D)

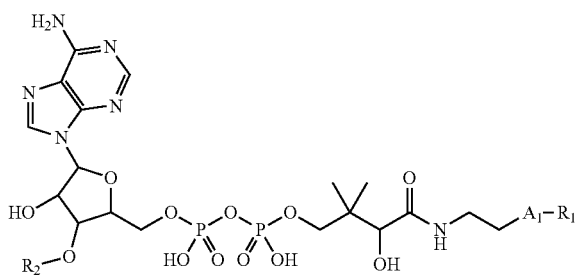

thereby attaching an activated phosphopentathienyl group of Formula (D-a) to the peptide tag, Formula (D-a)

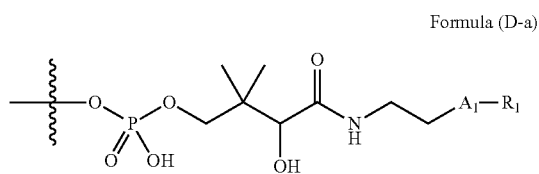

wherein $R_1$ is a functional group; and ii) reacting the functional group $R_1$ of the activated phosphopentathienyl group with a compound of Formula (II-a), X-$L_2$-$L_3$-$L_4$-TG     Formula (II-a)

wherein X is a group which reacts with functional group $R_1$,
wherein:
when X is a thiol, then $R_1$ is a thiol, a maleimide or a haloacetamide; or,
when X is a an azide, then $R_1$ is an alkyne, a triaryl phosphine, a cyclooctene or an oxanobornadiene; or,
when X is a triaryl phosphine, then $R_1$ is an azide; or,
when X is a an oxanobornadiene, then $R_1$ is an azide; or,
when X is a an alkyne, then $R_1$ is an azide; or,
when X is a an alkene, then $R_1$ is an azide; or,
when X is a cyclooctene, then $R_1$ is a diaryl tetrazine; or,
when X is a diaryl tetrazine, then $R_1$ is a cyclooctene; or,
when X is a monoaryl tetrazine, then $R_1$ is a norbornene; or,
when X is a norbornene, then $R_1$ is a monoaryl tetrazine; or,
when X is a an aldehyde, then $R_1$ is a hydroxylamine or a hydrazine or $NH_2$—NH—C(=O)—; or,
when X is a ketone, then $R_1$ is a hydroxylamine or a hydrazine or $NH_2$—NH—C(=O)—; or,
when X is a hydroxylamine, then $R_1$ is an aldehyde or a ketone; or,
when X is a hydrazine, then $R_1$ is an aldehyde or a ketone; or,
when X is a $NH_2$—NH—C(=O)—, then $R_1$ is an aldehyde or a ketone; or,
when X is a haloacetamide, then $R_1$ is a thiol; or,
when X is a maleimide, then $R_1$ is a thiol;

thereby the terminal group is attached to the peptide tag by a linker having the structure according to Formula (II-b):

Formula (II-b)

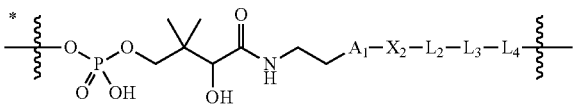

where the * denotes the phosphopantetheinyl moiety is attached to the peptide tag, and wherein $A_1$, $X_2$, $L_2$, $L_3$, $L_4$, $R_2$ and TG are as defined herein.

Another aspect provided herein is the preparation of an immunoconjugate by a process comprising the steps of:
(a) providing a modified antibody or antigen binding fragment thereof, wherein the modified antibody or antigen binding fragment thereof comprises a peptide tag, and wherein the peptide tag is a substrate of an enzyme having phosphopantetheinyl transferase activity;
(b) labeling the modified antibody or antigen binding fragment thereof with a terminal group (TG)
 i) by incubating the modified antibody or antigen binding fragment thereof with an enzyme having phosphopantetheinyl transferase activity in the presence of a compound of Formula (E), Formula (E)

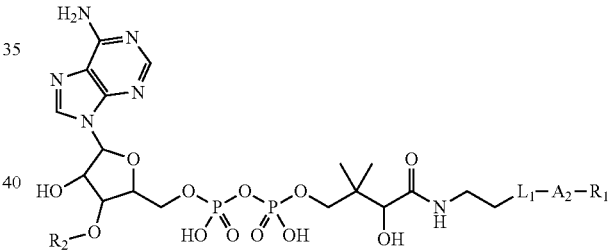

thereby attaching an activated phosphopentathienyl group of Formula (E-a) to the peptide tag, Formula (E-a)

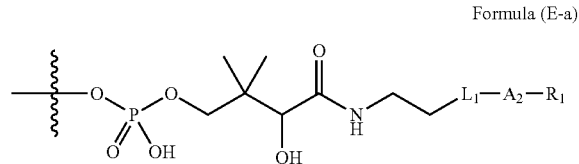

wherein $R_1$ is a functional group; and
ii) reacting the functional group $R_1$ of the activated phosphopentathienyl group with a compound of Formula (II-c), X-$L_3$-$L_4$-TG     Formula (II-c)

wherein X is a group which reacts with functional group $R_1$,
wherein:
when X is a thiol, then $R_1$ is a thiol, a maleimide or a haloacetamide; or, when X is a an azide, then $R_1$ is an alkyne, a triaryl phosphine, a cyclooctene or an oxanobornadiene; or, when X is a triaryl phosphine, then $R_1$ is an azide; or, when X is a an oxanobornadiene, then $R_1$ is an azide; or, when X is a an alkyne, then $R_1$ is an azide; or, when X is a an alkene, then $R_1$ is an azide; or, when X is a cyclooctene, then $R_1$ is a diaryl tetrazine; or, when X is a diaryl tetrazine, then $R_1$ is a cyclooctene; or, when X is a monoaryl tetrazine, then $R_1$ is a norbornene; or, when X is a norbornene, then $R_1$ is a monoaryl tetrazine; or, when X is a an aldehyde, then $R_1$ is a hydroxylamine or a hydrazine or $NH_2$—NH—C(=O)—; or, when X is a ketone, then $R_1$ is a hydroxylamine or a hydrazine or $NH_2$—NH—C(=O)—; or, when X is a hydroxylamine, then $R_1$ is an aldehyde or a ketone; or, when X is a hydrazine, then $R_1$ is an aldehyde or a ketone; or, when X is a $NH_2$—NH—C(=O)—, then $R_1$ is an aldehyde or a ketone; or, when X is a haloacetamide, then $R_1$ is a thiol; or, when X is a maleimide, then $R_1$ is a thiol;

thereby the terminal group is attached to the peptide tag by a linker having the structure according to Formula (II-d):

Formula (II-d)

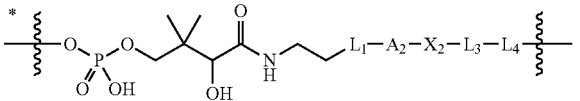

where the * denotes the phosphopantetheinyl moiety is attached to the peptide tag, and wherein $L_1$, $A_2$, $X_2$, $L_3$, $L_4$, $R_2$ and TG are as defined herein.

Another aspect provided herein is the preparation of an immunoconjugate by a process comprising the steps of:

(a) providing a modified antibody or antigen binding fragment thereof, wherein the modified antibody or antigen binding fragment thereof comprises a peptide tag, and wherein the peptide tag is a substrate of an enzyme having phosphopantetheinyl transferase activity;

(b) labeling the modified antibody or antigen binding fragment thereof with a terminal group (TG)

i) by incubating the modified antibody or antigen binding fragment thereof with an enzyme having phosphopantetheinyl transferase activity in the presence of a compound of Formula (F), Formula (F)

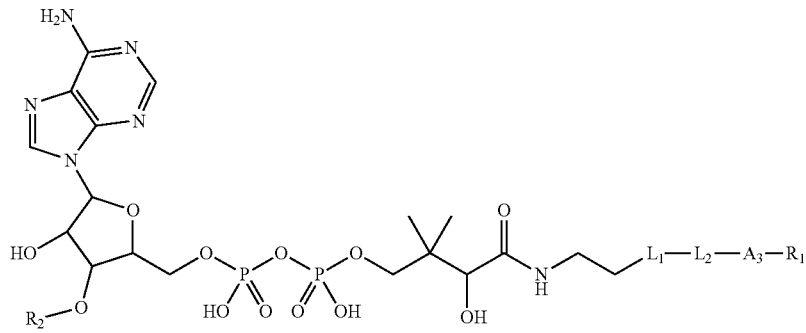

thereby attaching an activated phosphopentathienyl group of Formula (F-a) to the peptide tag, Formula (F-a)

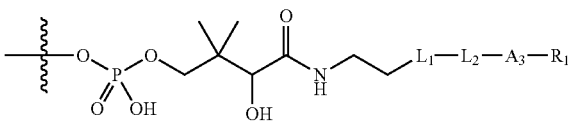

wherein $R_1$ is a functional group; and ii) reacting the functional group $R_1$ of the activated phosphopentathienyl group with a compound of Formula (II-e), X-$L_4$-TG  Formula (II-e)

wherein X is a group which reacts with functional group $R_1$, wherein:

when X is a thiol, then $R_1$ is a thiol, a maleimide or a haloacetamide; or, when X is a an azide, then $R_1$ is an alkyne, a triaryl phosphine, a cyclooctene or an oxanobornadiene; or, when X is a triaryl phosphine, then $R_1$ is an azide; or, when X is a an oxanobornadiene, then $R_1$ is an azide; or, when X is a an alkyne, then $R_1$ is an azide; or, when X is a an alkene, then $R_1$ is an azide; or, when X is a cyclooctene, then $R_1$ is a diaryl tetrazine; or, when X is a diaryl tetrazine, then $R_1$ is a cyclooctene; or, when X is a monoaryl tetrazine, then $R_1$ is a norbornene; or, when X is a norbornene, then $R_1$ is a monoaryl tetrazine; or, when X is a an aldehyde, then $R_1$ is a hydroxylamine or a hydrazine or $NH_2$—NH—C(=O)—; or, when X is a ketone, then $R_1$ is a hydroxylamine or a hydrazine or $NH_2$—NH—C(=O)—; or, when X is a hydroxylamine, then $R_1$ is an aldehyde or a ketone; or, when X is a hydrazine, then $R_1$ is an aldehyde or a ketone; or, when X is a $NH_2$—NH—C(=O)—, then $R_1$ is an aldehyde or a ketone; or, when X is a haloacetamide, then $R_1$ is a thiol; or, when X is a maleimide, then $R_1$ is a thiol;

thereby the terminal group is attached to the peptide tag by a linker having the structure according to Formula (II-f):

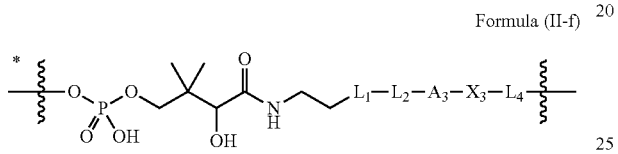

Formula (II-f)

where the * denotes the phosphopantetheinyl moiety is attached to the peptide tag, and wherein $L_1$, $L_2$, $A_3$, $X_2$, $L_4$, $R_2$ and TG are as defined herein.

Another aspect provided herein is the preparation of an immunoconjugate by a process comprising the steps of:

(a) providing a modified antibody or antigen binding fragment thereof, wherein the modified antibody or antigen binding fragment thereof comprises a peptide tag, and wherein the peptide tag is a substrate of an enzyme having phosphopantetheinyl transferase activity;

(b) labeling the modified antibody or antigen binding fragment thereof with a terminal group (TG)

i) by incubating the modified antibody or antigen binding fragment thereof with an enzyme having phosphopantetheinyl transferase activity in the presence of a compound of Formula (G),

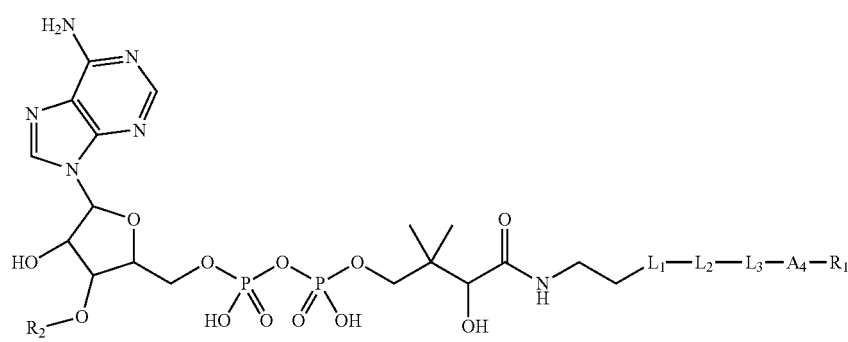

Formula (G)

thereby attaching an activated phosphopentathienyl group of Formula (G-a) to the peptide tag,

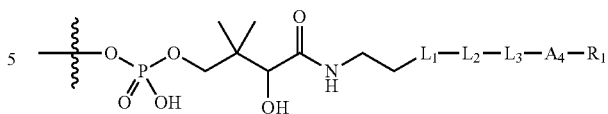

Formula (G-a)

wherein $R_1$ is a functional group; and ii) reacting the functional group $R_1$ of the activated phosphopentathienyl group with a compound of Formula (II-g), X-TG  Formula (II-g)

wherein X is a group which reacts with functional group $R_1$, wherein:

when X is a thiol, then $R_1$ is a thiol, a maleimide or a haloacetamide; or, when X is a an azide, then $R_1$ is an alkyne, a triaryl phosphine, a cyclooctene or an oxanobornadiene; or, when X is a triaryl phosphine, then $R_1$ is an azide; or, when X is a an oxanobornadiene, then $R_1$ is an azide; or, when X is a an alkyne, then $R_1$ is an azide; or, when X is a an alkene, then $R_1$ is an azide; or, when X is a cyclooctene, then $R_1$ is a diaryl tetrazine; or, when X is a diaryl tetrazine, then $R_1$ is a cyclooctene; or, when X is a monoaryl tetrazine, then $R_1$ is a norbornene; or, when X is a norbornene, then $R_1$ is a monoaryl tetrazine; or, when X is a an aldehyde, then $R_1$ is a hydroxylamine or a hydrazine or $NH_2$—NH—C(=O)—; or, when X is a ketone, then $R_1$ is a hydroxylamine or a hydrazine or $NH_2$—NH—C(=O)—; or, when X is a hydroxylamine, then $R_1$ is an aldehyde or a ketone; or, when X is a hydrazine, then $R_1$ is an aldehyde or a ketone; or, when X is a NH$_2$—NH—C(=O)—, then R$_1$ is an aldehyde or a ketone; or, when X is a haloacetamide, then R$_1$ is a thiol; or, when X is a maleimide, then R$_1$ is a thiol;

thereby the terminal group is attached to the peptide tag by a linker having the structure according to Formula (II-h):

Formula (II-h)

[Chemical structure: *—O—P(=O)(OH)—O—C(CH$_3$)$_2$—CH(OH)—C(=O)—NH—CH$_2$CH$_2$—L$_1$—L$_2$—L$_3$—A$_4$—X$_2$—]

where the * denotes the phosphopantetheinyl moiety is attached to the peptide tag, and wherein L$_1$, L$_2$, L$_3$, A$_4$, X$_2$, R$_2$ and TG are as defined herein.

Another aspect provided herein is the preparation of an immunoconjugate by a process comprising the steps of:

(a) providing a modified antibody or antigen binding fragment thereof, wherein the modified antibody or antigen binding fragment thereof comprises a peptide tag, and wherein the peptide tag is a substrate of an enzyme having phosphopantetheinyl transferase activity;

(b) labeling the modified antibody or antigen binding fragment thereof with a terminal group (TG) by incubating the modified antibody or antigen binding fragment thereof with an enzyme having phosphopantetheinyl transferase activity in the presence of a compound of Formula (H), Formula (H)

[Chemical structure of Formula (H)]

thereby attaching a protected phosphopentathienyl group of Formula (H-a) to the peptide tag, Formula (H-a)

[Chemical structure of Formula (H-a)]

wherein R$_1$—PG is a protected functional group R$_1$;

(c) deprotecting the protected phosphopentathienyl group to give an activated phosphopentathienyl group of Formula (D-a) attached to the peptide tag, Formula (D-a)

[Chemical structure of Formula (D-a)]

wherein R$_1$ is a functional group; and (d) reacting the functional group R$_1$ of the activated phosphopentathienyl group with a compound of Formula (II-a), X-L$_2$-L$_3$-L$_4$-TG    Formula (II-a)

wherein X is a group which reacts with functional group R$_1$, wherein:

when X is a thiol, then R$_1$ is a thiol, a maleimide or a haloacetamide; or, when X is a an azide, then R$_1$ is an alkyne, a triaryl phosphine, a cyclooctene or an oxanobornadiene; or, when X is a triaryl phosphine, then R$_1$ is an azide; or, when X is a an oxanobornadiene, then R$_1$ is an azide; or, when X is a an alkyne, then R$_1$ is an azide; or, when X is a an alkene, then R$_1$ is an azide; or, when X is a cyclooctene, then R$_1$ is a diaryl tetrazine; or, when X is a diaryl tetrazine, then R$_1$ is a cyclooctene; or, when X is a monoaryl tetrazine, then R$_1$ is a norbornene; or, when X is a norbornene, then R$_1$ is a monoaryl tetrazine; or, when X is a an aldehyde, then R$_1$ is a hydroxylamine or a hydrazine or NH$_2$—NH—C(=O)—; or, when X is a ketone, then R$_1$ is a hydroxylamine or a hydrazine or NH$_2$—NH—C(=O)—; or, when X is a hydroxylamine, then R$_1$ is an aldehyde or a ketone; or, when X is a hydrazine, then R$_1$ is an aldehyde or a ketone; or, when X is a NH$_2$—NH—C(=O)—, then R$_1$ is an aldehyde or a ketone; or, when X is a haloacetamide, then R$_1$ is a thiol; or, when X is a maleimide, then R$_1$ is a thiol;

thereby the terminal group is attached to the peptide tag by a linker having the structure according to Formula (II-b):

Formula (II-b)

[Chemical structure: *—O—P(=O)(OH)—O—C(CH$_3$)$_2$—CH(OH)—C(=O)—NH—CH$_2$CH$_2$—A$_1$—X$_2$—L$_2$—L$_3$—L$_4$—]

where the * denotes the phosphopantetheinyl moiety is attached to the peptide tag, and wherein A$_1$, X$_2$, L$_2$, L$_3$, L$_4$, R$_2$, PG and TG are as defined herein.

Another aspect provided herein is the preparation of an immunoconjugate by a process comprising the steps of:

(a) providing a modified antibody or antigen binding fragment thereof, wherein the modified antibody or antigen binding fragment thereof comprises a peptide tag, and wherein the peptide tag is a substrate of an enzyme having phosphopantetheinyl transferase activity;

(b) labeling the modified antibody or antigen binding fragment thereof with a terminal group (TG) by incubating the modified antibody or antigen binding fragment thereof with an enzyme having phosphopantetheinyl transferase activity in the presence of a compound of Formula (J),

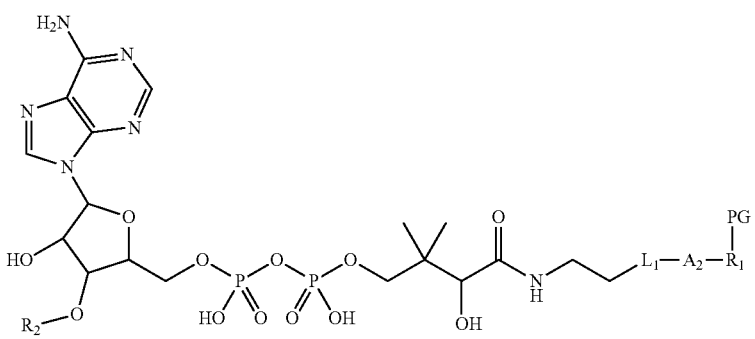

Formula (J)

thereby attaching a protected phosphopentathienyl group of Formula (J-a) to the peptide tag,

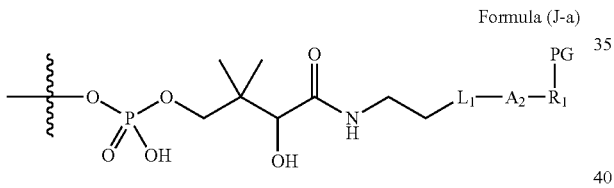

Formula (J-a)

wherein $R_1$—PG is a protected functional group $R_1$;

(c) deprotecting the protected phosphopentathienyl group to give an activated phosphopentathienyl group of Formula (E-a) attached to the peptide tag,

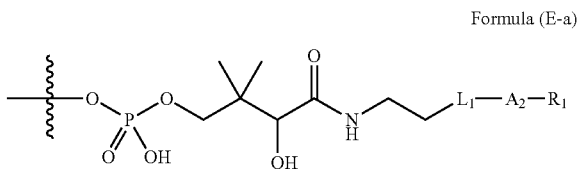

Formula (E-a)

wherein $R_1$ is a functional group; and (d) reacting the functional group $R_1$ of the activated phosphopentathienyl group with a compound of Formula (II-c),

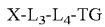-$L_3$-$L_4$-TG  Formula (II-c)

wherein X is a group which reacts with functional group $R_1$,
wherein:
when X is a thiol, then $R_1$ is a thiol, a maleimide or a haloacetamide; or, when X is a an azide, then $R_1$ is an alkyne, a triaryl phosphine, a cyclooctene or an oxanobornadiene; or,
when X is a triaryl phosphine, then $R_1$ is an azide; or,
when X is a an oxanobornadiene, then $R_1$ is an azide; or,
when X is a an alkyne, then $R_1$ is an azide; or,
when X is a an alkene, then $R_1$ is an azide; or,
when X is a cyclooctene, then $R_1$ is a diaryl tetrazine; or,
when X is a diaryl tetrazine, then $R_1$ is a cyclooctene; or,
when X is a monoaryl tetrazine, then $R_1$ is a norbornene; or,
when X is a norbornene, then $R_1$ is a monoaryl tetrazine; or,
when X is a an aldehyde, then $R_1$ is a hydroxylamine or a hydrazine or $NH_2$—NH—C(=O)—; or,
when X is a ketone, then $R_1$ is a hydroxylamine or a hydrazine or $NH_2$—NH—C(=O)—; or,
when X is a hydroxylamine, then $R_1$ is an aldehyde or a ketone; or,
when X is a hydrazine, then $R_1$ is an aldehyde or a ketone; or,
when X is a $NH_2$—NH—C(=O)—, then $R_1$ is an aldehyde or a ketone; or,
when X is a haloacetamide, then $R_1$ is a thiol; or,
when X is a maleimide, then $R_1$ is a thiol;
thereby the terminal group is attached to the peptide tag by a linker having the structure according to Formula (II-d):

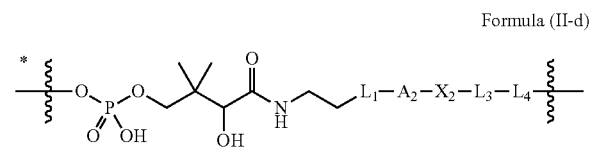

Formula (II-d)

where the * denotes the phosphopantetheinyl moiety is attached to the peptide tag, and wherein $L_1$, $A_2$, $X_2$, $L_3$, $L_4$, $R_2$, PG and TG are as defined herein.

Another aspect provided herein is the preparation of an immunoconjugate by a process comprising the steps of:
(a) providing a modified antibody or antigen binding fragment thereof, wherein the modified antibody or antigen binding fragment thereof comprises a peptide tag, and wherein the peptide tag is a substrate of an enzyme having phosphopantetheinyl transferase activity;

(b) labeling the modified antibody or antigen binding fragment thereof with a terminal group (TG) by incubating the modified antibody or antigen binding fragment thereof with an enzyme having phosphopantetheinyl transferase activity in the presence of a compound of Formula (K),

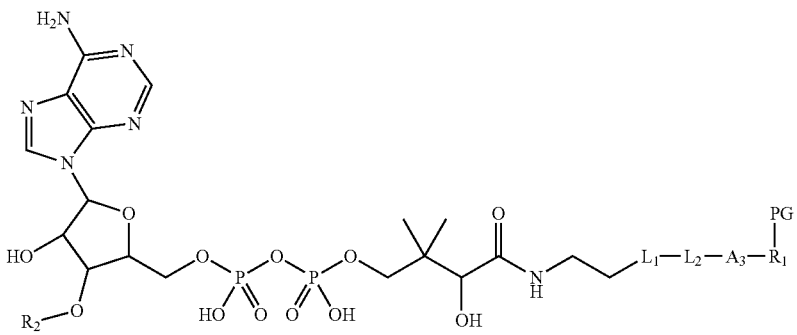

Formula (K)

thereby attaching a protected phosphopentathienyl group of Formula (J-a) to the peptide tag,

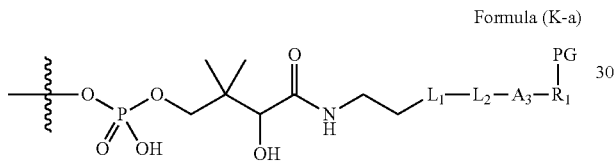

Formula (K-a)

wherein $R_1$—PG is a protected functional group $R_1$;

(c) deprotecting the protected phosphopentathienyl group to give an activated phosphopentathienyl group of Formula (F-a) attached to the peptide tag,

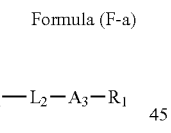

Formula (F-a)

wherein $R_1$ is a functional group; and (d) reacting the functional group $R_1$ of the activated phosphopentathienyl group with a compound of Formula (II-e), X-$L_4$-TG    Formula (II-e)

wherein X is a group which reacts with functional group $R_1$,
wherein:
when X is a thiol, then $R_1$ is a thiol, a maleimide or a haloacetamide; or,
when X is a an azide, then $R_1$ is an alkyne, a triaryl phosphine, a cyclooctene or an oxanobornadiene; or,
when X is a triaryl phosphine, then $R_1$ is an azide; or,
when X is a an oxanobornadiene, then $R_1$ is an azide; or,
when X is a an alkyne, then $R_1$ is an azide; or, when X is a an alkene, then $R_1$ is an azide; or,
when X is a cyclooctene, then $R_1$ is a diaryl tetrazine; or,
when X is a diaryl tetrazine, then $R_1$ is a cyclooctene; or,
when X is a monoaryl tetrazine, then $R_1$ is a norbornene; or,
when X is a norbornene, then $R_1$ is a monoaryl tetrazine; or,
when X is a an aldehyde, then $R_1$ is a hydroxylamine or a hydrazine or $NH_2$—NH—C(=O)—; or,
when X is a ketone, then $R_1$ is a hydroxylamine or a hydrazine or $NH_2$—NH—C(=O)—; or,
when X is a hydroxylamine, then $R_1$ is an aldehyde or a ketone; or,
when X is a hydrazine, then $R_1$ is an aldehyde or a ketone; or,
when X is a $NH_2$—NH—C(=O)—, then $R_1$ is an aldehyde or a ketone; or,
when X is a haloacetamide, then $R_1$ is a thiol; or,
when X is a maleimide, then $R_1$ is a thiol;
thereby the terminal group is attached to the peptide tag by a linker having the structure according to Formula (IV):

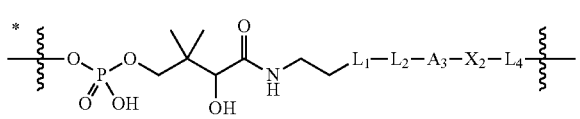

Formula (II-f)

where the * denotes the phosphopantetheinyl moiety is attached to the peptide tag, and wherein $L_1$, $L_2$, $A_3$, $X_2$, $L_4$, $R_2$, PG and TG are as defined herein.

Another aspect provided herein is the preparation of an immunoconjugate by a process comprising the steps of:
(a) providing a modified antibody or antigen binding fragment thereof, wherein the modified antibody or antigen binding fragment thereof comprises a peptide tag, and wherein the peptide tag is a substrate of an enzyme having phosphopantetheinyl transferase activity;
(b) labeling the modified antibody or antigen binding fragment thereof with a terminal group (TG) by incubating the modified antibody or antigen binding fragment thereof with an enzyme having phosphopantetheinyl transferase activity in the presence of a compound of Formula (L), Formula (L)

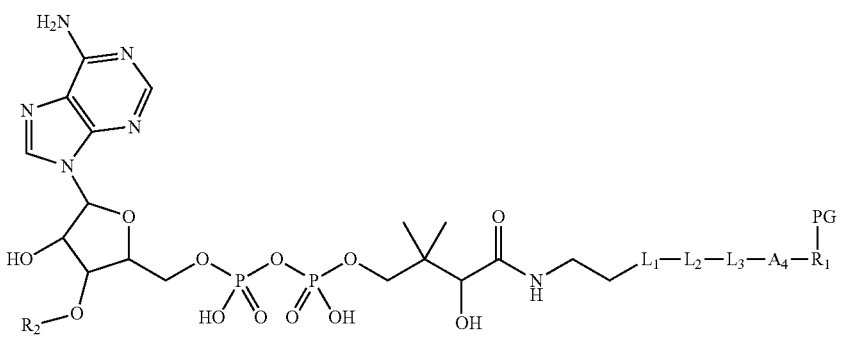

thereby attaching a protected phosphopentathienyl group of Formula (L-a) to the peptide tag, Formula (L-a)

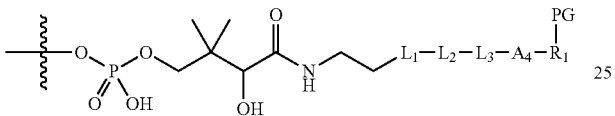

wherein $R_1$—PG is a protected functional group $R_1$;

(c) deprotecting the protected phosphopentathienyl group to give an activated phosphopentathienyl group of Formula (G-a) attached to the peptide tag, Formula (G-a)

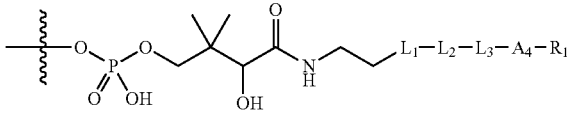

wherein $R_1$ is a functional group; and (d) reacting the functional group $R_1$ of the activated phosphopentathienyl group with a compound of Formula (II-g), X-TG            Formula (II-g)

wherein X is a group which reacts with functional group $R_1$,
wherein:
when X is a thiol, then $R_1$ is a thiol, a maleimide or a haloacetamide; or,
when X is a an azide, then $R_1$ is an alkyne, a triaryl phosphine, a cyclooctene or an oxanobornadiene; or,
when X is a triaryl phosphine, then $R_1$ is an azide; or,
when X is a an oxanobornadiene, then $R_1$ is an azide; or,
when X is a an alkyne, then $R_1$ is an azide; or,
when X is a an alkene, then $R_1$ is an azide; or,
when X is a cyclooctene, then $R_1$ is a diaryl tetrazine; or,
when X is a diaryl tetrazine, then $R_1$ is a cyclooctene; or,
when X is a monoaryl tetrazine, then $R_1$ is a norbornene; or,
when X is a norbornene, then $R_1$ is a monoaryl tetrazine; or,
when X is a an aldehyde, then $R_1$ is a hydroxylamine or a hydrazine or $NH_2$—NH—C(=O)—; or,
when X is a ketone, then $R_1$ is a hydroxylamine or a hydrazine or $NH_2$—NH—C(=O)—; or,
when X is a hydroxylamine, then $R_1$ is an aldehyde or a ketone; or,
when X is a hydrazine, then $R_1$ is an aldehyde or a ketone; or,
when X is a $NH_2$—NH—C(=O)—, then $R_1$ is an aldehyde or a ketone; or,
when X is a haloacetamide, then $R_1$ is a thiol; or,
when X is a maleimide, then $R_1$ is a thiol;
thereby the terminal group is attached to the peptide tag by a linker having the structure according to Formula (II-h):

Formula (II-h)

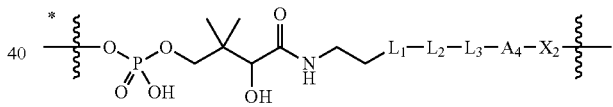

where the * denotes the phosphopantetheinyl moiety is attached to the peptide tag, and wherein $L_1$, $L_2$, $L_3$, $A_4$, $X_2$, $R_2$, PG and TG are as defined herein In certain embodiments of the above methods of preparation $A_1$ is —C(=O)NH—, —NHC(=O)—, —C(=O)NH$(CH_2)_n$—, —C(=O)NH$(C(R^4)_2)_n$—, —O$(CH_2)_n)_m$—, —O$(C(R^4)_2)_n)_m$—, —$((CH_2)_n$O$)_m$—, —$(((C(R^4)_2)_n$O$)_m$—, —$((CH_2)_n$O$)_m(CH_2)_n$—, —$(((C(R^4)_2)_n$O$)_m C(R^4)_2)_n$—, —$(CH_2)_n$C(=O)NH—, —$(C(R^4)_2)_n$C(=O)NH—, —$(CH_2)_n$NHC(=O)—, —$(C(R^4)_2)_n$NHC(=O)—, —NHC(=O)$(CH_2)_n$—, —NHC(=O)$(C(R^4)_2)_n$—, —C(=O)NH$(CH_2)_n$S—, —C(=O)NH$(C(R^4)_2)_n$S—, —S$(CH_2)_n$C(=O)NH—, —S$(C(R^4)_2)_n$C(=O)NH—, —C(=O)NH$(CH_2)_n$NHC(=O)$(CH_2)_n$—, —C(=O)NH$(C(R^4)_2)_n$NHC(=O)$(C(R^4)_2)_n$—, —C(=O)$(CH_2)_n$—, —C(=O)$(C(R^4)_2)_n$—, —$(CH_2)_n$C(=O)—, —$(C(R^4)_2)_n$C(=O)—, —$(CH_2)_n$(O$(CH_2)_n)_m$NHC(=O)$(CH_2)_n$—, —$(C(R^4)_2)_n$(O$(C(R^4)_2)_n)_m$NHC(=O)$(C(R^4)_2)_n$—, —$(CH_2)_n$NHC(=O)$(CH_2)_n$—, —$(C(R^4)_2)_n$NHC(=O)$(C(R^4)_2)_n$—, —$(CH_2)_n$NH$((CH_2)_n$O$)_m(CH_2)_n$—, —$(C(R^4)_2)_n$NH$((C(R^4)_2)_n$O$)_m(C(R^4)_2)_n$—, —$(O(CH_2)_n)_m$NHC(=O)$(CH_2)_n$—, or —$(O(C(R^4)_2)_n)_m$NHC(=O)$(C(R^4)_2)_n$—;

$L_2$ is a bond, -$A_2$-, or -$A_2X^2$—;
$L_3$ is a bond, -$A_3$-, or -$A_3X^2$—;
$L_4$ is a bond, -$A_4$-, -$A_4X^2$—,

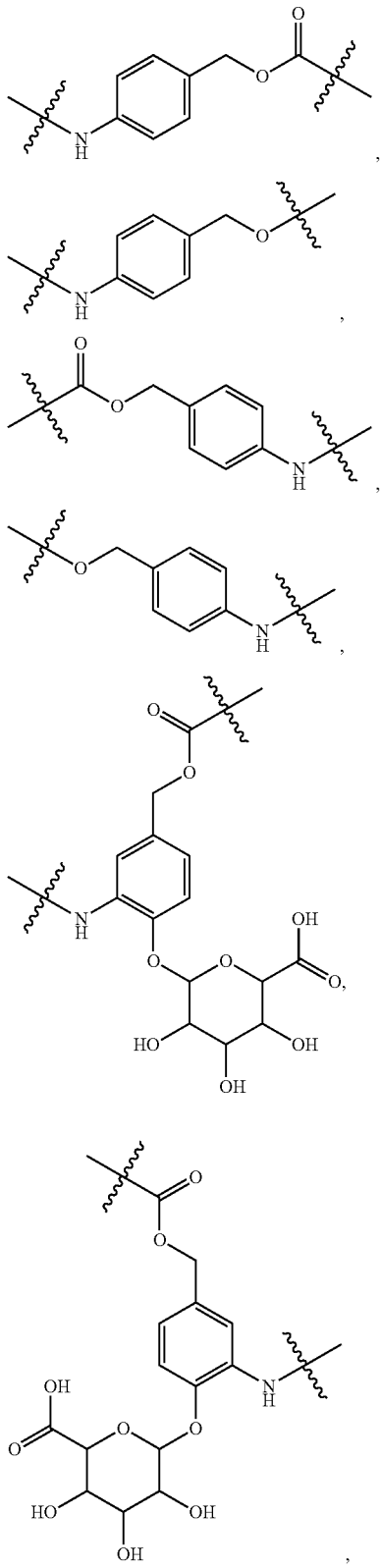

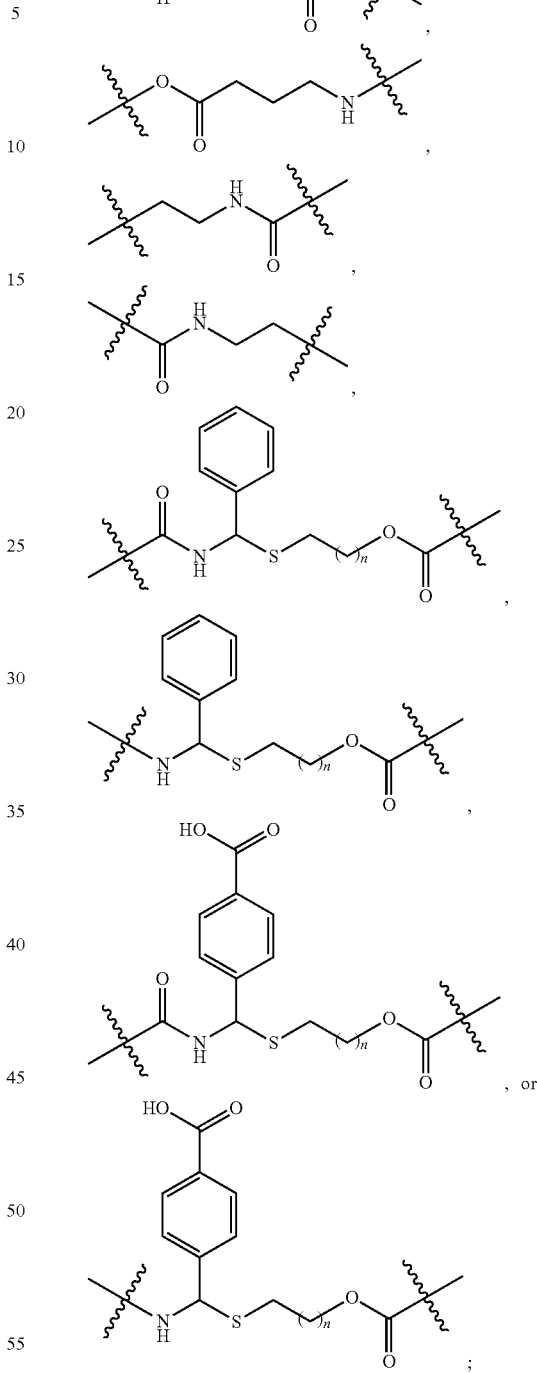

$A_2$ is —C(=O)NH—, —C(=O)NH(CH$_2$)$_n$—, —C(=O)NH(C(R$^4$)$_2$)$_n$—, —(O(CH$_2$)$_n$)$_m$—, —(O(C(R$^4$)$_2$)$_n$)$_m$—, —((CH$_2$)$_n$O)$_m$—, —(((C(R$^4$)$_2$)$_n$O)$_m$—, —((CH$_2$)$_n$O)$_m$(CH$_2$)$_n$—, —(((C(R$^4$)$_2$)$_n$O)$_m$C(R$^4$)$_2$)$_n$—, —(CH$_2$)$_n$C(=O)NH—, —(C(R$^4$)$_2$)$_n$C(=O)NR$^4$—, —(CH$_2$)$_n$NHC(=O)—, —(C(R$^4$)$_2$)$_n$NHC(=O)—, —NHC(=O)(CH$_2$)$_n$—, —NHC(=O)(C(R$^4$)$_2$)$_n$—, —C(=O)NH(CH$_2$)$_n$S—, —C(=O)NH(C(R$^4$)$_2$)$_n$S—, —S(CH$_2$)$_n$C(=O)NH—, —S(C(R$^4$)$_2$)$_n$C(=O)NH—, —(CH$_2$)$_n$S—, —(C(R$^4$)$_2$)$_n$S—, —S(CH$_2$)$_n$—, —S(C $(R^4)_2)_n$—, —$(CH_2)_n NH$—, —$(C(R^4)_2)_n NH$—, —$C(=O)NH(CH_2)_n NHC(=O)(CH_2)_n$—, —$C(=O)NH(C(R^4)_2)_n NHC(=O)(C(R^4)_2)_n$—, —$C(=O)(CH_2)_n$—, —$C(=O)(C(R^4)_2)_n$—, —$(CH_2)_n C(=O)$—, —$(C(R^4)_2)_n C(=O)$—, —$(CH_2)_n (O(CH_2)_n)_m NHC(=O)(CH_2)_n$—, —$(C(R^4)_2)_n (O(C(R^4)_2)_n)_m NHC(=O)(C(R^4)_2)_n$—, —$(CH_2)_n (O(CH_2)_n)_m OC(=O)NH(CH_2)_n$—, —$(C(R^4)_2)_n (O(C(R^4)_2)_n)_m C(=O)NH(C(R^4)_2)_n$—, —$(CH_2)_n NHC(=O)(CH_2)_n$—, —$(C(R^4)_2)_n NHC(=O)(C(R^4)_2)_n$—, —$(CH_2)_n NH((CH_2)_n O)_m (CH_2)_n$—, —$(C(R^4)_2)_n NH((C(R^4)_2)_n O)_m (C(R^4)_2)_n$—, —$(O(CH_2)_n)_m NHC(=O)(CH_2)_n$—, —$(O(C(R^4)_2)_n)_m NHC(=O)(C(R^4)_2)_n$—,

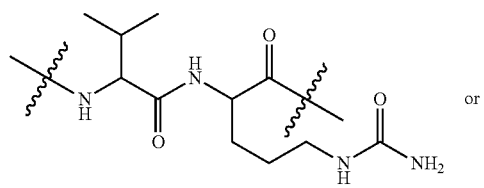

or

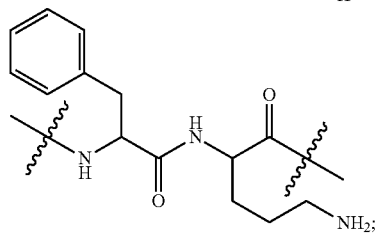

$A_3$ is —$C(=O)NH$—, —$C(=O)NH(CH_2)_n$—, —$C(=O)NH(C(R^4)_2)_n$—, —$(O(CH_2)_n)_m$—, —$(O(C(R^4)_2)_n)_m$—, —$((CH_2)_n O)_m$—, —$(((C(R^4)_2)_n O)_m$—, —$((CH_2)_n O)_m (CH_2)_n$—, —$(((C(R^4)_2)_n O)_m C(R^4)_2)_n$—, —$(CH_2)_n C(=O)NH$—, —$(C(R^4)_2)_n C(=O)NH$—, —$(CH_2)_n NHC(=O)$—, —$(C(R^4)_2)_n NHC(=O)$—, —$NHC(=O)(CH_2)_n$—, —$NHC(=O)(C(R^4)_2)_n$—, —$C(=O)NH(CH_2)_n S$—, —$C(=O)NH(C(R^4)_2)_n S$—, —$S(CH_2)_n C(=O)NH$—, —$S(C(R^4)_2)_n C(=O)NH$—, —$(CH_2)_n S$—, —$(C(R^4)_2)_n S$—, —$S(CH_2)_n$—, —$S(C(R^4)_2)_n$—, —$C(=O)NH(CH_2)_n NHC(=O)(CH_2)_n$—, —$C(=O)NH(C(R^4)_2)_n NHC(=O)(C(R^4)_2)_n$—, —$C(=O)(CH_2)_n$—, —$C(=O)(C(R^4)_2)_n$—, —$(CH_2)_n C(=O)$—, —$(C(R^4)_2)_n C(=O)$—, —$(CH_2)_n (O(CH_2)_n)_m NHC(=O)(CH_2)_n$—, —$(C(R^4)_2)_n (O(C(R^4)_2)_n)_m NHC(=O)(C(R^4)_2)_n$—, —$(CH_2)_n (O(CH_2)_n)_m OC(=O)NH(CH_2)_n$—, —$(C(R^4)_2)_n (O(C(R^4)_2)_n)_m OC(=O)NH(C(R^4)_2)_n$—, —$(CH_2)_n (O(CH_2)_n)_m OC(=O)$—, —$(C(R^4)_2)_n (O(C(R^4)_2)_n)_m OC(=O)$—, —$(CH_2)_n (O(CH_2)_n)_m C(=O)$—, —$(C(R^4)_2)_n (O(C(R^4)_2)_n)_m C(=O)$—, —$(CH_2)_n NHC(=O)(CH_2)_n$—, —$(C(R^4)_2)_n NHC(=O)(C(R^4)_2)_n$—, —$(O(CH_2)_n)_m NHC(=O)(CH_2)_n$—, —$(O(C(R^4)_2)_n)_m NHC(=O)(C(R^4)_2)_n$—,

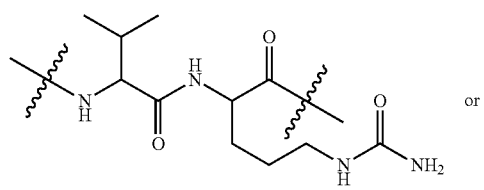

or

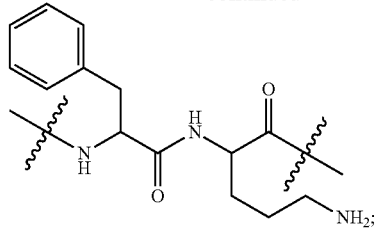

$A_4$ is —$C(=O)NH$—, —$C(=O)NH(CH_2)_n$—, —$C(=O)NH(C(R^4)_2)_n$—, —$(O(CH_2)_n)_m$—, —$(O(C(R^4)_2)_n)_m$—, —$((CH_2)_n O)_m$—, —$(((C(R^4)_2)_n O)_m$—, —$((CH_2)_n O)_m (CH_2)_n$—, —$(((C(R^4)_2)_n O)_m C(R^4)_2)_n$—, —$(CH_2)_n C(=O)NH$—, —$(C(R^4)_2)_n C(=O)NH$—, —$(CH_2)_n NHC(=O)$—, —$(C(R^4)_2)_n NHC(=O)$—, —$NHC(=O)(CH_2)_n$—, —$NHC(=O)(C(R^4)_2)_n$—, —$C(=O)NH(CH_2)_n S$—, —$C(=O)NH(C(R^4)_2)_n S$—, —$S(CH_2)_n C(=O)NH$—, —$S(C(R^4)_2)_n C(=O)NH$—, —$C(=O)NH(CH_2)_n NHC(=O)(CH_2)_n$—, —$C(=O)NH(C(R^4)_2)_n NHC(=O)(C(R^4)_2)_n$—, —$C(=O)(CH_2)_n$—, —$C(=O)(C(R^4)_2)_n$—, —$(CH_2)_n C(=O)$—, —$(C(R^4)_2)_n C(=O)$—, —$(CH_2)_n (O(CH_2)_n)_m NHC(=O)(CH_2)_n$—, —$(C(R^4)_2)_n (O(C(R^4)_2)_n)_m NHC(=O)(C(R^4)_2)_n$—, —$(CH_2)_n NHC(=O)(CH_2)_n$—, —$(C(R^4)_2)_n NHC(=O)(C(R^4)_2)_n$—, —$(CH_2)_n NH((CH_2)_n O)_m (CH_2)_n$—, —$(C(R^4)_2)_n NH((C(R^4)_2)_n O)_m (C(R^4)_2)_n$—, —$(O(CH_2)_n)_m NHC(=O)(CH_2)_n$—, or —$(O(C(R^4)_2)_n)_m NHC(=O)(C(R^4)_2)_n$—;

each $X^2$ is independently selected from a bond,

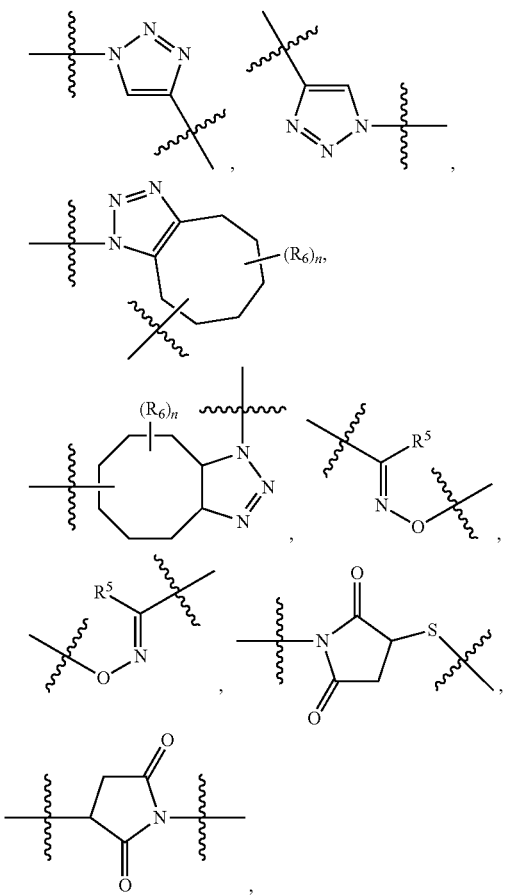

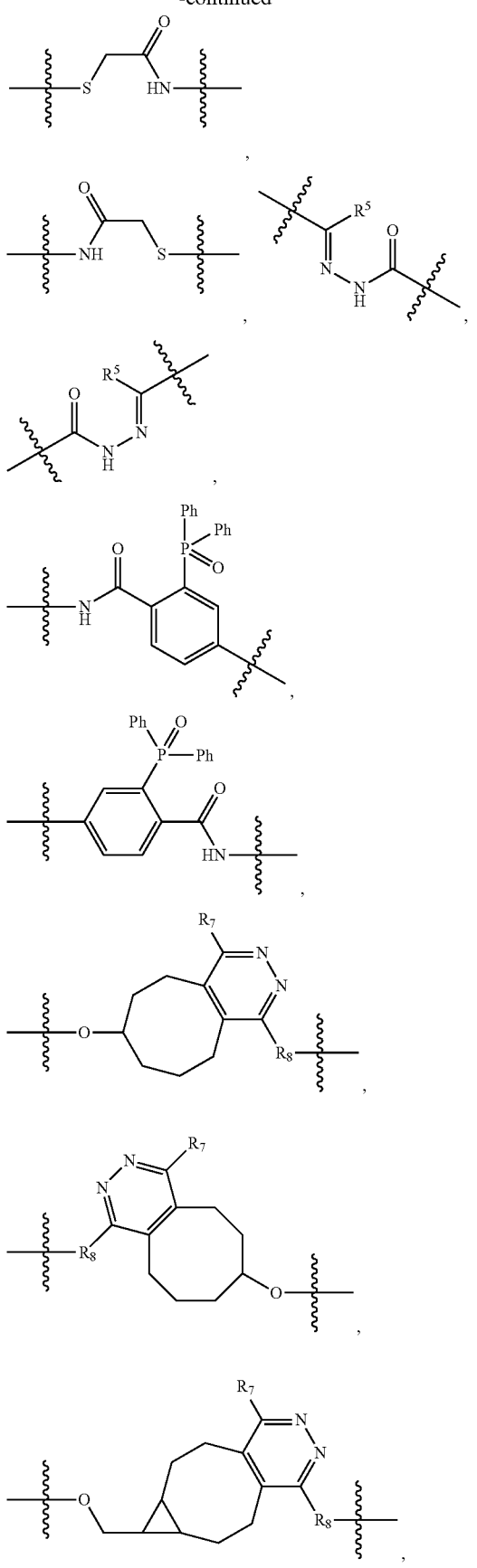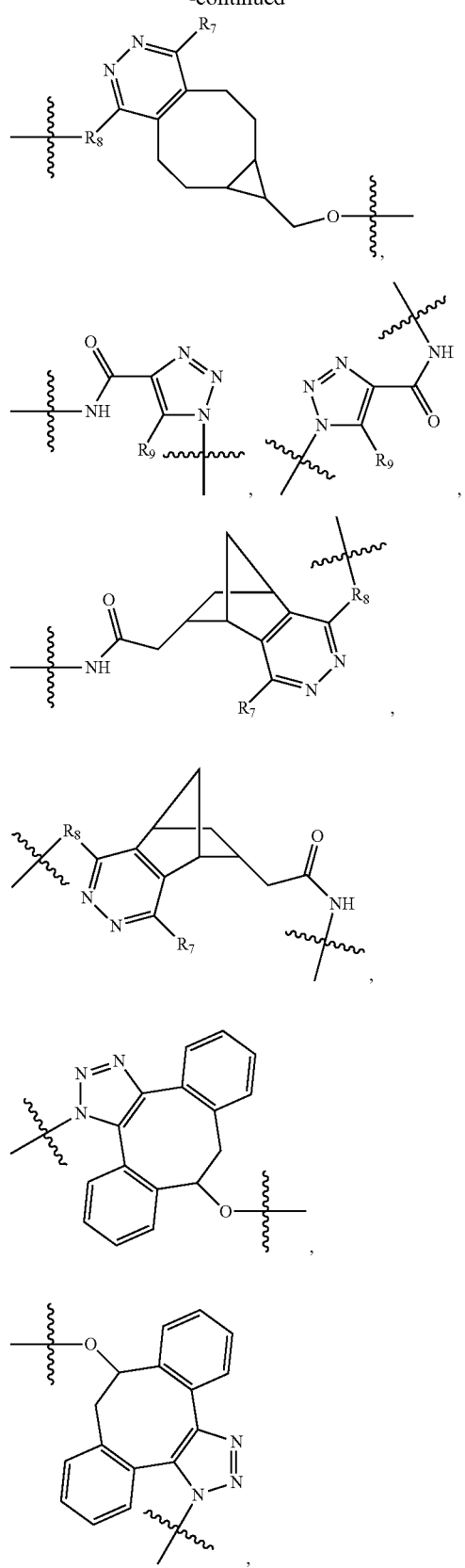
—S—, —Si(OH)$_2$O—,

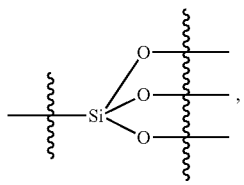

—CHR⁴(CH₂)ₙC(=O)NH—, —CHR⁴(CH₂)ₙNHC(=O)—, —C(=O)NH— and —NHC(=O)—;

each R⁴ is independently selected from H, C₁₋₄alkyl, —C(=O)OH and —OH, each R⁵ is independently selected from H, C₁₋₄alkyl, phenyl or C₁₋₄alkyl substituted with 1 to 3 —OH groups;

each R⁶ is independently selected from H, fluoro, benzyloxy substituted with —C(=O)OH, benzyl substituted with —C(=O)OH, C₁₋₄alkoxy substituted with —C(=O)OH and C₁₋₄alkyl substituted with —C(=O)OH;

R⁷ is independently selected from H, phenyl and pyridine;

R⁸ is independently selected from

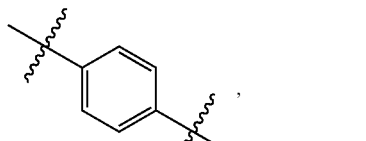

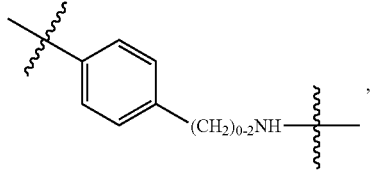

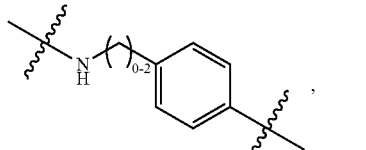

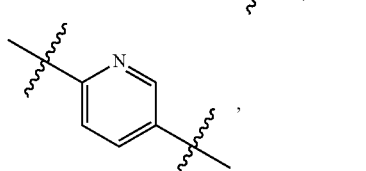

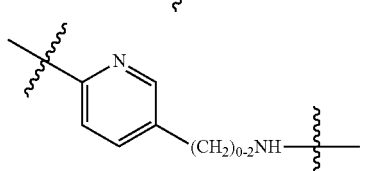

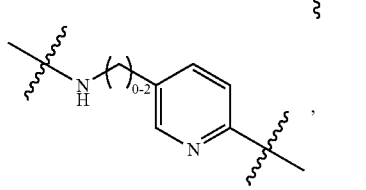

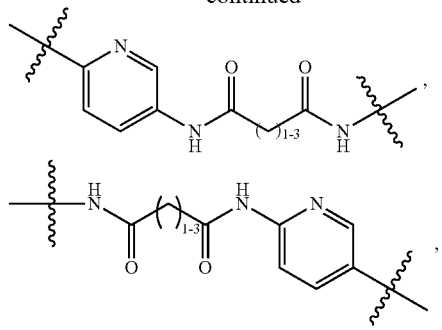

R⁹ is independently selected from H and C₁₋₆haloalkyl;

each n is independently selected from 1, 2, 3, 4, 5, 6, 7, 8 and 9;

each m is independently selected from 1, 2, 3, 4, 5, 6, 7, 8 and 9, and

TG is selected from a drug moiety, an affinity probe, a chelator, a spectroscopic probe, a radioactive probe, a lipid molecule, a polyethylene glycol, a polymer, a nanoparticle, a quantum dot, a liposome, a PLGA particle, and a polysaccharide.

In other embodiments of the above methods of preparation

A₁ is —C(=O)NH—, —C(=O)NH(CH₂)ₙ—, —C(=O)NH(CH₂)ₙS—, —(O(CH₂)ₙ)ₘ—, —((CH₂)ₙO)ₘ(CH₂)ₙ—, —NHC(=O)(CH₂)ₙ—, —(CH₂)ₙNHC(=O)—, —C(=O)NH(CH₂)ₙNHC(=O)(CH₂)ₙ—, —(CH₂)ₙNH((CH₂)ₙO)ₘ(CH₂)ₙ— or —(O(CH₂)ₙ)ₘNHC(=O)(CH₂)ₙ—;

L₂ is a bond, -A₂-, or -A₂X²—;

L₃ is a bond, -A₃-, or -A₃X²—;

L₄ is a bond, -A₄-, -A₄X²—,

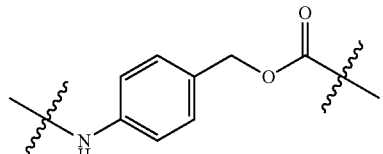

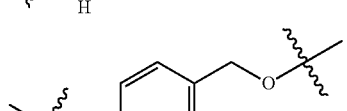

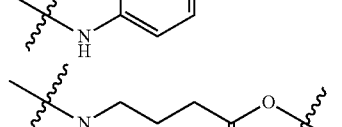

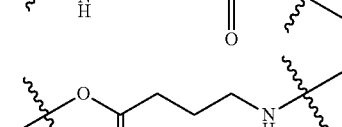

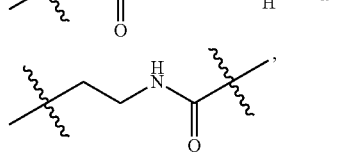

-continued

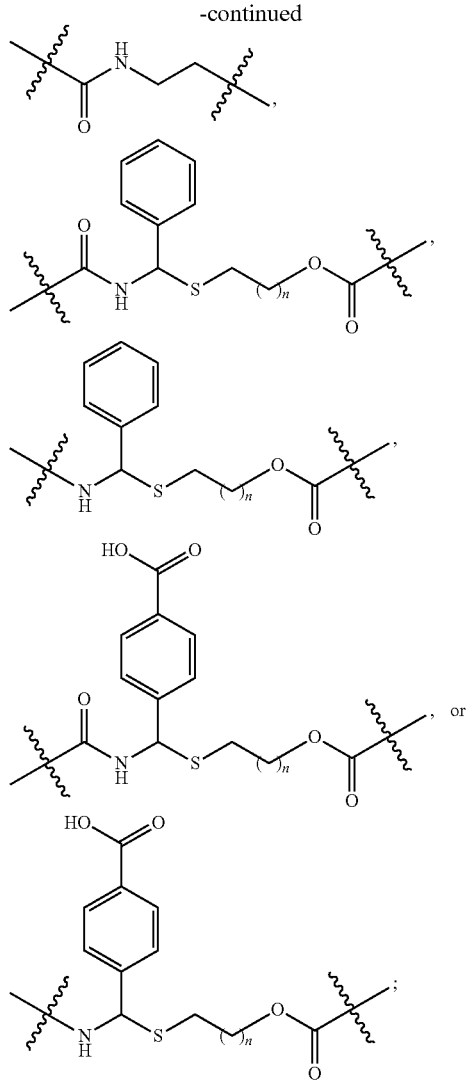

$A_1$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$— or —(O(CH$_2$)$_n$)$_m$NHC(=O)(CH$_2$)$_n$—;

$A_2$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$—, —(O(CH$_2$)$_n$)$_m$NHC(=O)(CH$_2$)$_n$— or

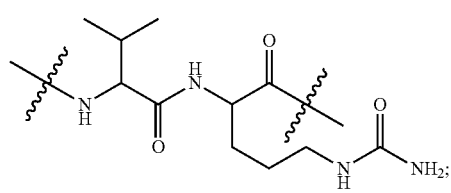 [SMILES: *NC(C(=O)NC(CCCNC(N)=O)C(*)=O)C(C)C]

$A_3$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$—, —(O(CH$_2$)$_n$)$_m$NHC(=O)(CH$_2$)$_n$— or

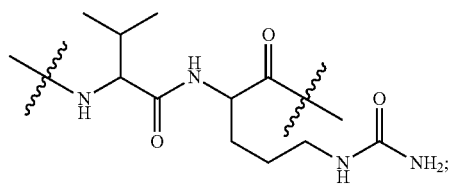 [SMILES: *NC(C(=O)NC(CCCNC(N)=O)C(*)=O)C(C)C]

$A_4$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$— or —(O(CH$_2$)$_n$)$_m$NHC(=O)(CH$_2$)$_n$—;

each $X^2$ is independently selected from a bond,

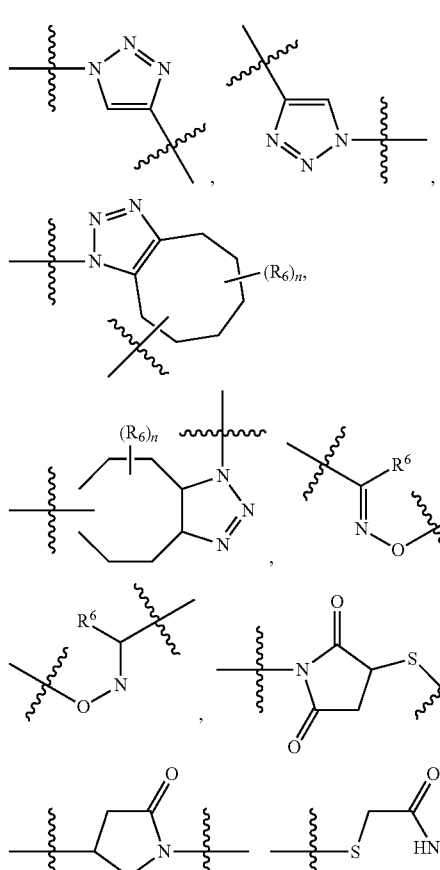

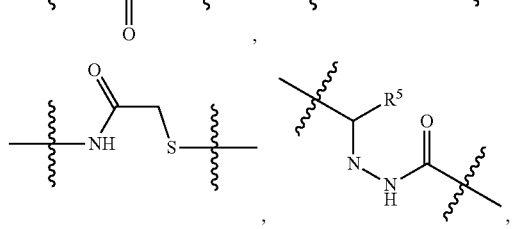

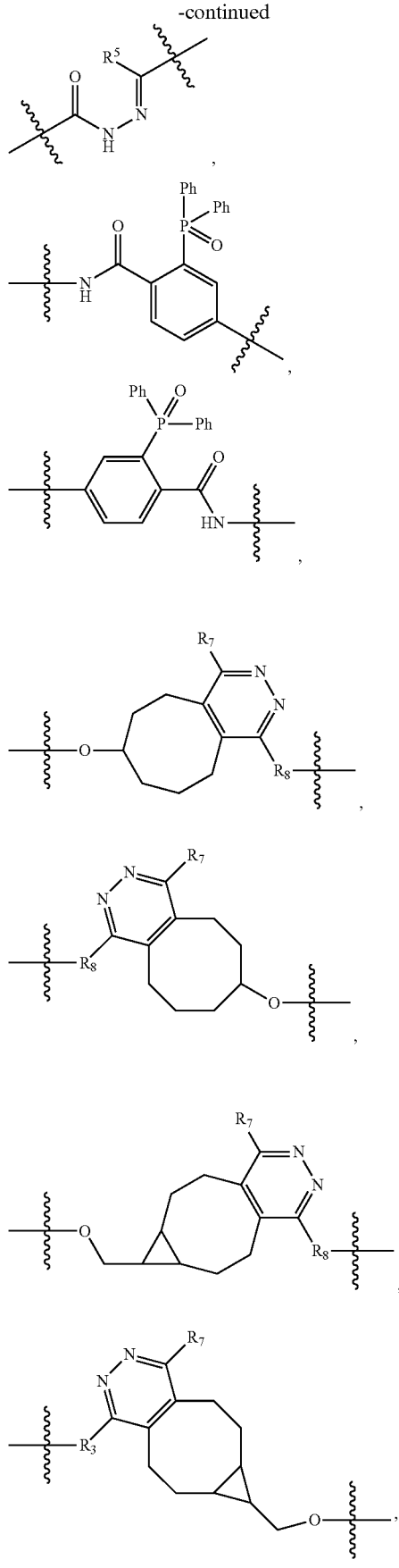
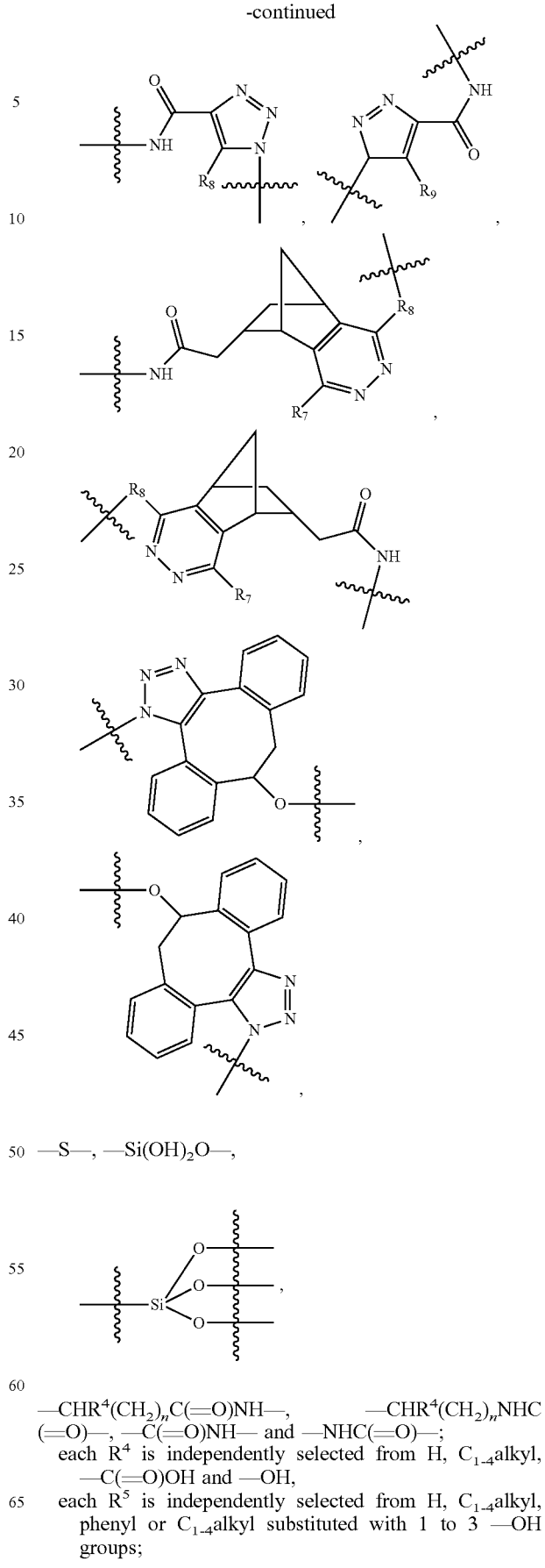
—S—, —Si(OH)$_2$O—,
—CHR$^4$(CH$_2$)$_n$C(=O)NH—, —CHR$^4$(CH$_2$)$_n$NHC(=O)—, —C(=O)NH— and —NHC(=O)—;
each R$^4$ is independently selected from H, C$_{1-4}$alkyl, —C(=O)OH and —OH,
each R$^5$ is independently selected from H, C$_{1-4}$alkyl, phenyl or C$_{1-4}$alkyl substituted with 1 to 3 —OH groups;

each $R^6$ is independently selected from H, fluoro, benzyloxy substituted with —C(=O)OH, benzyl substituted with —C(=O)OH, $C_{1-4}$alkoxy substituted with —C(=O)OH and $C_{1-4}$alkyl substituted with —C(=O)OH;

$R^7$ is independently selected from H, phenyl and pyridine;

$R^8$ is independently selected from

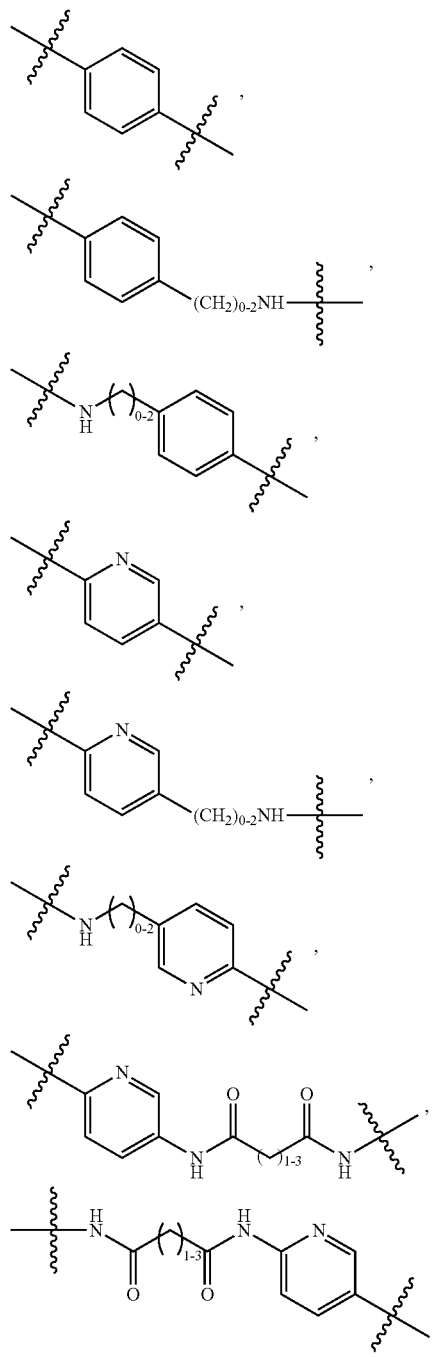

$R^9$ is independently selected from H and $C_{1-6}$haloalkyl;

each n is independently selected from 1, 2, 3, 4, 5, 6, 7, 8 and 9, and each m is independently selected from 1, 2, 3, 4, 5, 6, 7, 8 and 9.

In other embodiments of the above methods of preparation $L_1$ is a bond, $-A_1-$, $-A_1X^2—$ or $—X^2—$;

$L_3$ is a bond, $-A_3-$, or $-A_3X^2—$;

$L_4$ is a bond, $-A_4-$, $-A_4X^2—$,

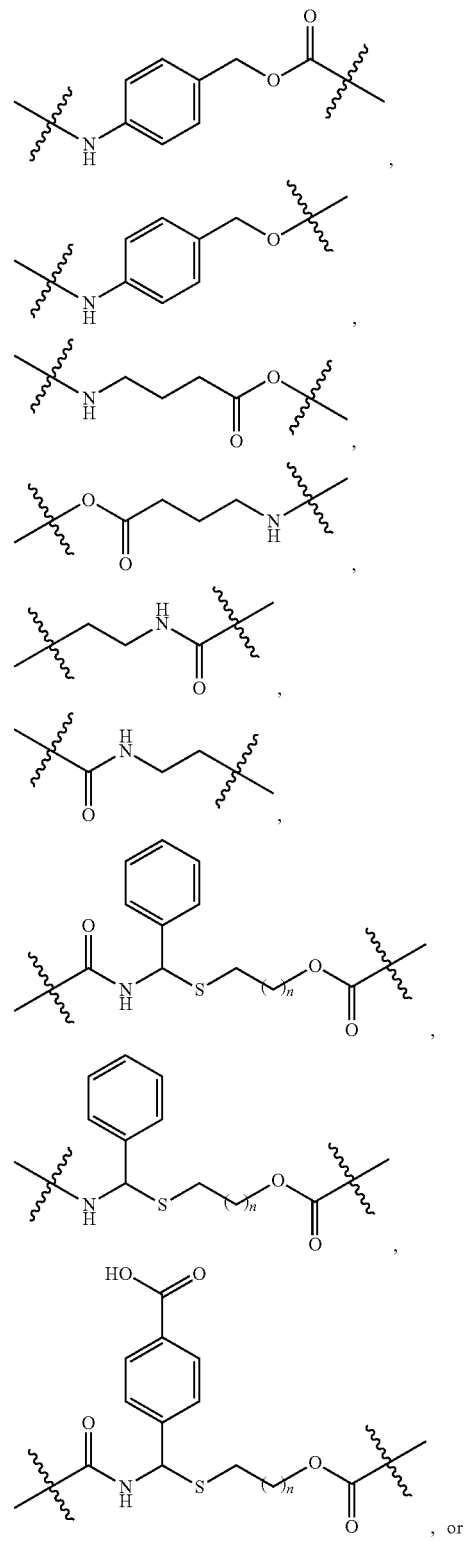

-continued

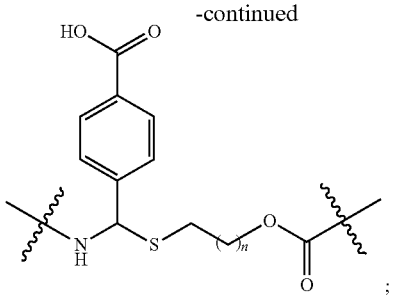

$A_1$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$— or —(O(CH$_2$)$_n$)$_m$NHC(=O)(CH$_2$)$_n$—;

$A_2$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$—, —(O(CH$_2$)$_n$)$_m$NHC(=O)(CH$_2$)$_n$— or

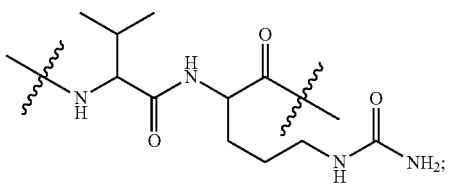 [SMILES: *NC(C(=O)NC(CCCNC(N)=O)C(*)=O)C(C)C]

$A_3$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$—, —(O(CH$_2$)$_n$)$_m$NHC(=O)(CH$_2$)$_n$— or

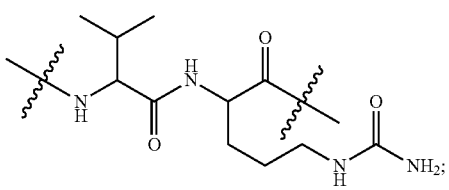 [SMILES: *NC(C(=O)NC(CCCNC(N)=O)C(*)=O)C(C)C]

$A_4$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$— or —(O(CH$_2$)$_n$)$_m$NHC(=O)(CH$_2$)$_n$—;

each $X^2$ is independently selected from a bond,

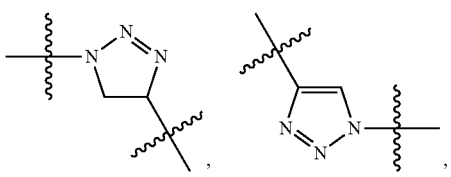

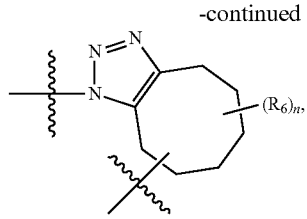

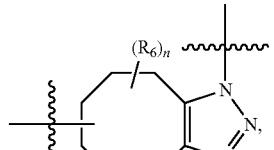

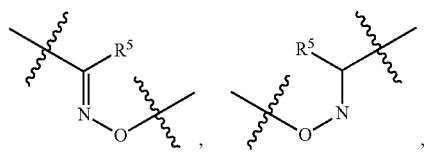

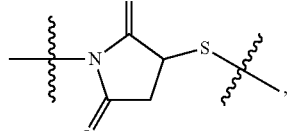

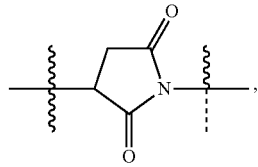

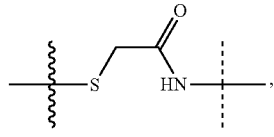

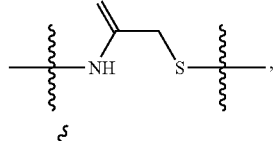

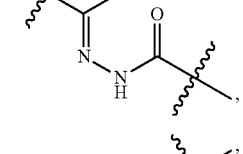

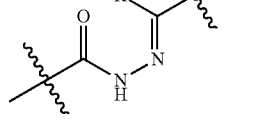

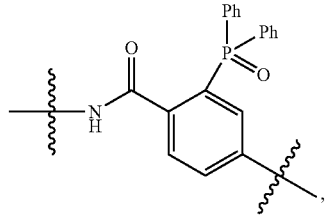

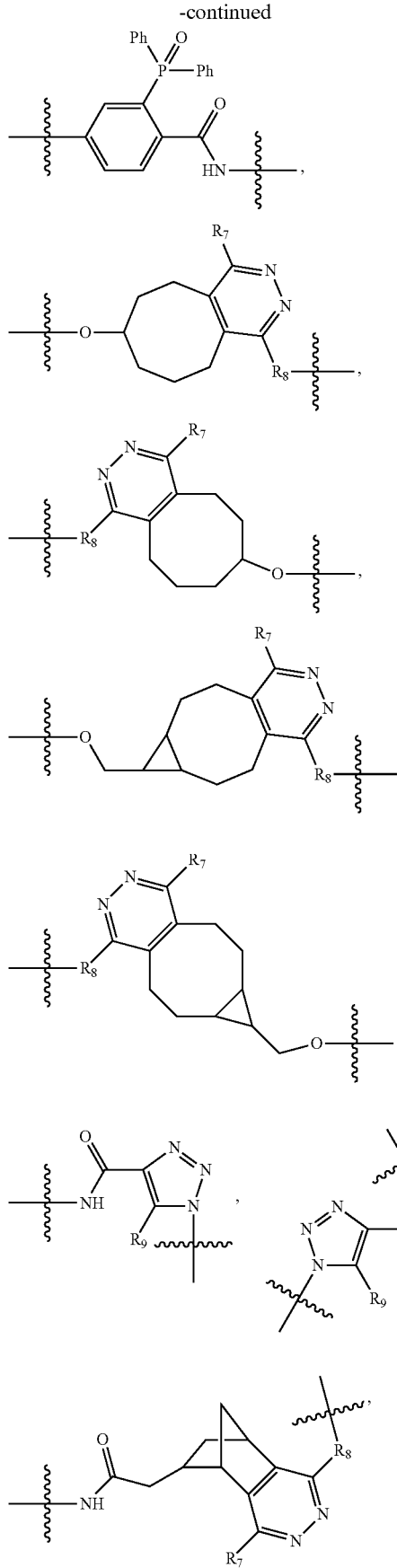
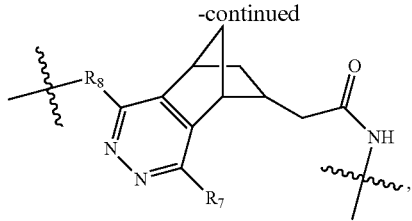
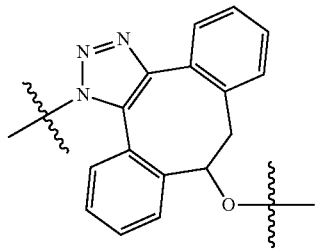
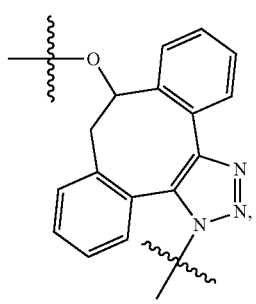

—S—, —Si(OH)$_2$O—,

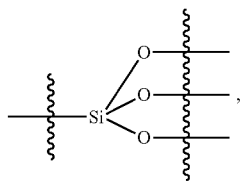

—CHR$^4$(CH$_2$)$_n$C(=O)NH—, —CHR$^4$(CH$_2$)$_n$NHC(=O)—, —C(=O)NH— and —NHC(=O)—;

each R$^4$ is independently selected from H, C$_{1-4}$alkyl, —C(=O)OH and —OH, each R$^5$ is independently selected from H, C$_{1-4}$alkyl, phenyl or C$_{1-4}$alkyl substituted with 1 to 3 —OH groups;

each R$^6$ is independently selected from H, fluoro, benzyloxy substituted with —C(=O)OH, benzyl substituted with —C(=O)OH, C$_{1-4}$alkoxy substituted with —C(=O)OH and C$_{1-4}$alkyl substituted with —C(=O)OH;

R$^7$ is independently selected from H, phenyl and pyridine;

R$^8$ is independently selected from

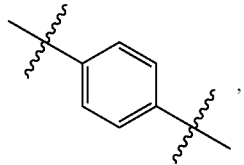

-continued

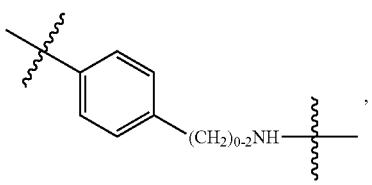

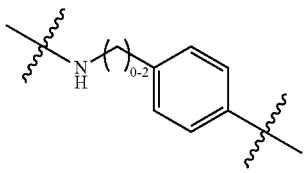

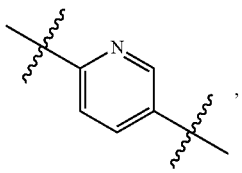

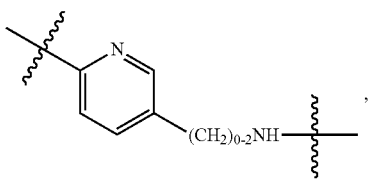

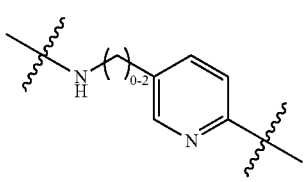

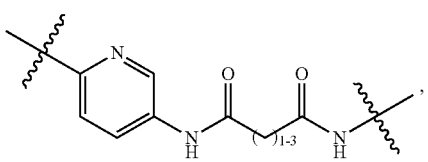

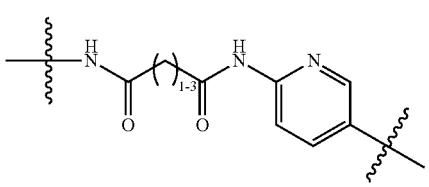

$R^9$ is independently selected from H and $C_{1-6}$haloalkyl;

each n is independently selected from 1, 2, 3, 4, 5, 6, 7, 8 and 9, and each m is independently selected from 1, 2, 3, 4, 5, 6, 7, 8 and 9.

Another aspect provided herein are conjugated antibodies or antibody fragment thereof, comprising the modified antibody or antibody fragment provided herein, wherein a serine residue of the peptide tag in the modified antibody or antibody fragment thereof is conjugated to a 4'-phosphopantetheine group having the structure of Formula (D-a), Formula (E-a), Formula (F-a) or Formula (G-a):

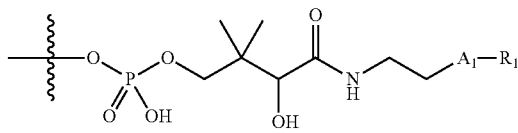

Formula (D-a)

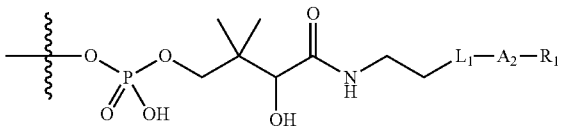

Formula (E-a)

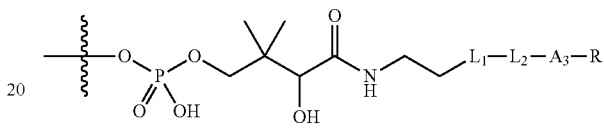

Formula (F-a)

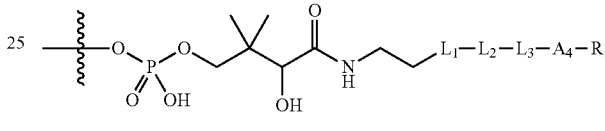

Formula (G-a)

wherein:

$L_1$ is -$A_1X^2$— or —$X^2$—;

$L_2$ is a bond, -$A_2$-, or -$A_2X^2$—;

$L_3$ is a bond, -$A_3$-, or -$A_3X^2$—;

$L_4$ is a bond, -$A_4$-, -$A_4X^2$—,

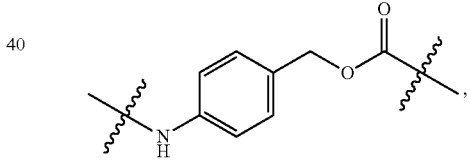

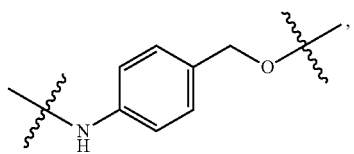

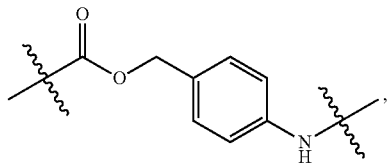

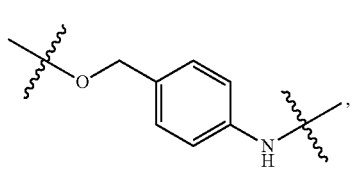

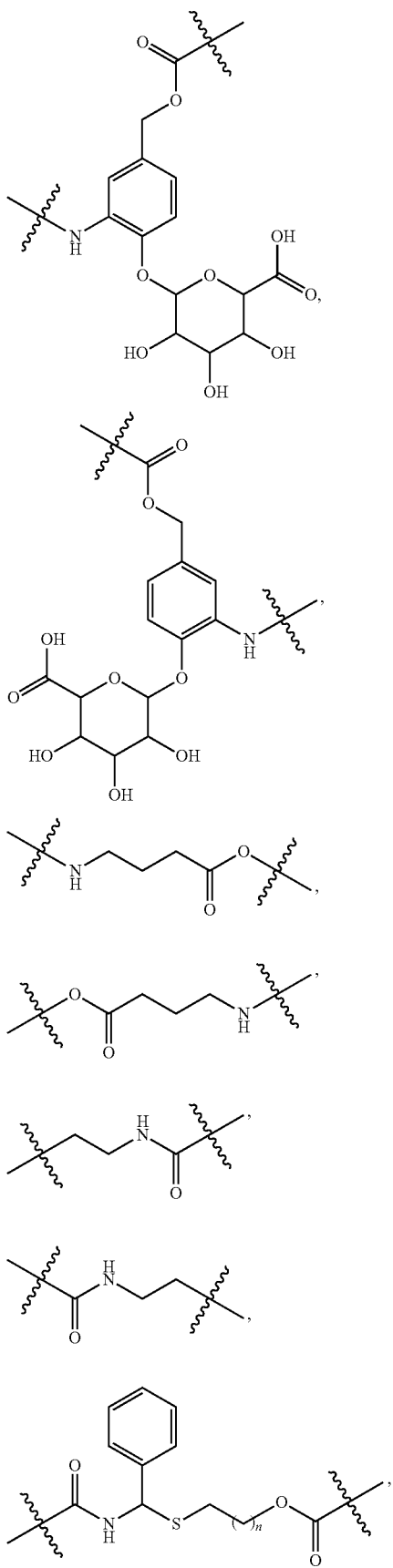

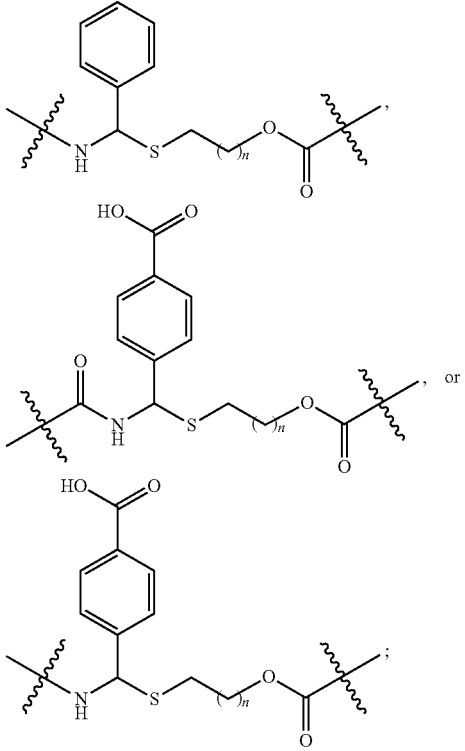

$A_1$ is —C(=O)NH—, —NHC(=O)—, —C(=O)NH(CH$_2$)$_n$—, —C(=O)NH(C(R$^4$)$_2$)$_n$—, —(O(CH$_2$)$_n$)$_m$—, —(O(C(R$^4$)$_2$)$_n$)$_m$—, —((CH$_2$)$_n$O)$_m$—, —(((C(R$^4$)$_2$)$_n$O)$_m$—, —((CH$_2$)$_n$O)$_m$(CH$_2$)$_n$—, —(((C(R$^4$)$_2$)$_n$O)$_m$C(R$^4$)$_2$)$_n$—, —(CH$_2$)$_n$C(=O)NH—, —(C(R$^4$)$_2$)$_n$C(=O)NH—, —(CH$_2$)$_n$NHC(=O)—, —(C(R$^4$)$_2$)$_n$NHC(=O)—, —NHC(=O)(CH$_2$)$_n$—, —NHC(=O)(C(R$^4$)$_2$)$_n$—, —C(=O)NH(CH$_2$)$_n$S—, —C(=O)NH(C(R$^4$)$_2$)$_n$S—, —S(CH$_2$)$_n$C(=O)NH—, —S(C(R$^4$)$_2$)$_n$C(=O)NH—, —C(=O)NH(CH$_2$)$_n$NHC(=O)(CH$_2$)$_n$—, —C(=O)NH(C(R$^4$)$_2$)$_n$NHC(=O)(C(R$^4$)$_2$)$_n$—, —C(=O)(CH$_2$)$_n$—, —C(=O)(C(R$^4$)$_2$)$_n$—, —(CH$_2$)$_n$C(=O)—, —(C(R$^4$)$_2$)$_n$C(=O)—, —(CH$_2$)$_n$(O(CH$_2$)$_n$)$_m$NHC(=O)(CH$_2$)$_n$—, —(C(R$^4$)$_2$)$_n$(O(C(R$^4$)$_2$)$_n$)$_m$NHC(=O)(C(R$^4$)$_2$)$_n$—, —(CH$_2$)$_n$NHC(=O)(CH$_2$)$_n$—, —(C(R$^4$)$_2$)$_n$NHC(=O)(C(R$^4$)$_2$)$_n$—, —(CH$_2$)$_n$NH((CH$_2$)$_n$O)$_m$(CH$_2$)$_n$—, —(C(R$^4$)$_2$)$_n$NH(((C(R$^4$)$_2$)$_n$O)$_m$C(R$^4$)$_2$)$_n$—, —(O(CH$_2$)$_n$)$_m$NHC(=O)(CH$_2$)$_n$—, or —(O(C(R$^4$)$_2$)$_n$)$_m$NHC(=O)(C(R$^4$)$_2$)$_n$—;

$A_2$ is —C(=O)NH—, —C(=O)NH(CH$_2$)$_n$—, —C(=O)NH(C(R$^4$)$_2$)$_n$—, —(O(CH$_2$)$_n$)$_m$—, —(O(C(R$^4$)$_2$)$_n$)$_m$—, —((CH$_2$)$_n$O)$_m$—, —(((C(R$^4$)$_2$)$_n$O)$_m$—, —((CH$_2$)$_n$O)$_m$(CH$_2$)$_n$—, —(((C(R$^4$)$_2$)$_n$O)$_m$C(R$^4$)$_2$)$_n$—, —(CH$_2$)$_n$C(=O)NH—, —(C(R$^4$)$_2$)$_n$C(=O)NR$^4$—, —(CH$_2$)$_n$NHC(=O)—, —(C(R$^4$)$_2$)$_n$NHC(=O)—, —NHC(=O)(CH$_2$)$_n$—, —NHC(=O)(C(R$^4$)$_2$)$_n$—, —C(=O)NH(CH$_2$)$_n$S—, —C(=O)NH(C(R$^4$)$_2$)$_n$S—, —S(CH$_2$)$_n$C(=O)NH—, —S(C(R$^4$)$_2$)$_n$C(=O)NH—, —(CH$_2$)$_n$S—, —(C(R$^4$)$_2$)$_n$S—, —S(CH$_2$)$_n$—, —S(C(R$^4$)$_2$)$_n$—, —(CH$_2$)$_n$NH—, —(C(R$^4$)$_2$)$_n$NH—, —C(=O)NH(CH$_2$)$_n$NHC(=O)(CH$_2$)$_n$—, —C(=O)NH(C(R$^4$)$_2$)$_n$NHC(=O)(C(R$^4$)$_2$)$_n$—, —C(=O)(CH$_2$)$_n$—, —C(=O)(C(R$^4$)$_2$)$_n$—, —(CH$_2$)$_n$C(=O)—, —(C(R$^4$)$_2$)$_n$C(=O)—, —(CH$_2$)$_n$(O(CH$_2$)$_n$)$_m$NHC(=O)(CH$_2$)$_n$—, —(C(R$^4$)$_2$)$_n$(O(C(R$^4$)$_2$)$_n$)$_m$NHC(=O)

—(C(R⁴)₂)ₙ—, —(CH₂)ₙ(O(CH₂)ₙ)ₘC(=O)NH (CH₂)ₙ—, —(C(R⁴)₂)ₙ(O(C(R⁴)₂)ₙ)ₘOC(=O)NH(C (R⁴)₂)ₙ—, —(CH₂)ₙNHC(=O)(CH₂)ₙ—, —(C(R⁴)₂)ₙNHC(=O)(C(R⁴)₂)ₙ—, —(CH₂)ₙNH ((CH₂)ₙO)ₘ(CH₂)ₙ—, —(C(R⁴)₂)ₙNH((C(R⁴)₂)ₙO)ₘ (C(R⁴)₂)ₙ—, —(O(CH₂)ₙ)ₘNHC(=O)(CH₂)ₙ—, —(O (C(R⁴)₂)ₙ)ₘNHC(=O)(C(R⁴)₂)ₙ—,

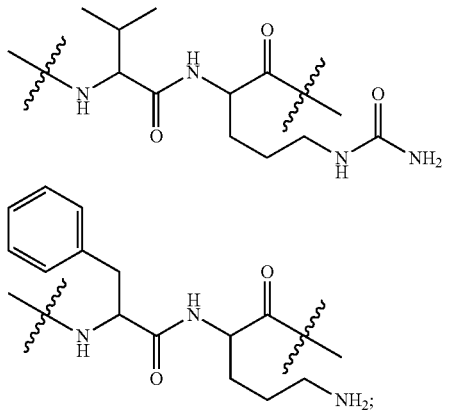

or

A₃ is —C(=O)NH—, —C(=O)NH(CH₂)ₙ—, —C(=O) NH(C(R⁴)₂)ₙ—, —(O(CH₂)ₙ)ₘ—, —(O(C(R⁴)₂)ₙ)ₘ—, —((CH₂)ₙO)ₘ—, —(((C(R⁴)₂)ₙO)ₘ—, —((CH₂)ₙO)ₘ (CH₂)ₙ—, —(((C(R⁴)₂)ₙO)ₘC(R⁴)₂)ₙ—, —(CH₂)ₙC (=O)NH—, —(C(R⁴)₂)ₙC(=O)NH—, —(CH₂)ₙNHC(=O)—, —(C(R⁴)₂)ₙNHC(=O)—, —NHC(=O)(CH₂)ₙ—, —NHC(=O)(C(R⁴)₂)ₙ—, —C(=O)NH(CH₂)ₙS—, —C(=O)NH(C(R⁴)₂)ₙS—, —S(CH₂)ₙC(=O)NH—, —S(C(R⁴)₂)ₙC(=O)NH—, —(CH₂)ₙS—, —(C(R⁴)₂)ₙS—, —S(CH₂)ₙ—, —S(C (R⁴)₂)ₙ—, —C(=O)NH(CH₂)ₙNHC(=O)(CH₂)ₙ—, —C(=O)NH(C(R⁴)₂)ₙNHC(=O)(C(R⁴)₂)ₙ—, —C(=O)(CH₂)ₙ—, —C(=O)(C(R⁴)₂)ₙ—, —(CH₂)ₙC(=O)—, —(C(R⁴)₂)ₙC(=O)—, —(CH₂)ₙ O(CH₂)ₙ)ₘNHC(=O)(CH₂)ₙ—, —(C(R⁴)₂)ₙ(O(C (R⁴)₂)ₙ)ₘNHC(=O)(C(R⁴)₂)ₙ—, —(CH₂)ₙ(O (CH₂)ₙ)ₘOC(=O)NH(CH₂)ₙ—, —(C(R⁴)₂)ₙ(O (C(R⁴)₂)ₙ)ₘOC(=O)NH(C(R⁴)₂)ₙ—, —(CH₂)ₙ(O (CH₂)ₙ)ₘOC(=O)—, —(C(R⁴)₂)ₙ(O(C(R⁴)₂)ₙ)ₘC (=O)—, —(CH₂)ₙ(O(CH₂)ₙ)ₘC(=O)—, —(C(R⁴)₂)ₙ (O(C(R⁴)₂)ₙ)ₘC(=O)—, —(CH₂)ₙNHC(=O) (CH₂)ₙ—, —(C(R⁴)₂)ₙNHC(=O)(C(R⁴)₂)ₙ—, —(O (CH₂)ₙ)ₘNHC(=O)(CH₂)ₙ—, —(O(C(R⁴)₂)ₙ)ₘNHC (=O)(C(R⁴)₂)ₙ—,

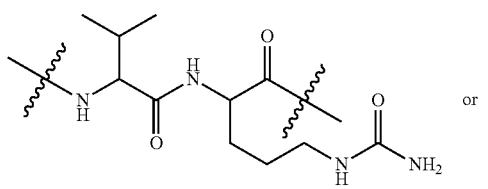

A₄ is —C(=O)NH—, —C(=O)NH(CH₂)ₙ—, —C(=O) NH(C(R⁴)₂)ₙ—, —(O(CH₂)ₙ)ₘ—, —(O(C(R⁴)₂)ₙ)ₘ—, —((CH₂)ₙO)ₘ—, —(((C(R⁴)₂)ₙO)ₘ—, —((CH₂)ₙO)ₘ (CH₂)ₙ—, —(((C(R⁴)₂)ₙO)ₘC(R⁴)₂)ₙ—, —(CH₂)ₙC (=O)NH—, —(C(R⁴)₂)ₙC(=O)NH—, —(CH₂)ₙNHC(=O)—, —(C(R⁴)₂)ₙNHC(=O)—, —NHC(=O)(CH₂)ₙ—, —NHC(=O)(C(R⁴)₂)ₙ—, —C(=O)NH(CH₂)ₙS—, —C(=O)NH(C(R⁴)₂)ₙS—, —S(CH₂)ₙC(=O)NH—, —S(C(R⁴)₂)ₙC(=O)NH—, —C(=O)NH(CH₂)ₙNHC(=O)(CH₂)ₙ—, —C(=O) NH(C(R⁴)₂)ₙNHC(=O)(C(R⁴)₂)ₙ—, —C(=O) (CH₂)ₙ—, —C(=O)(C(R⁴)₂)ₙ—, —(CH₂)ₙC(=O)—, —(C(R⁴)₂)ₙC(=O)—, —(CH₂)ₙ(O(CH₂)ₙ)ₘNHC (=O)(CH₂)ₙ—, —(C(R⁴)₂)ₙ(O(C(R⁴)₂)ₙ)ₘNHC(=O) (C(R⁴)₂)ₙ—, —(CH₂)ₙNHC(=O)(CH₂)ₙ—, —(C(R⁴)₂)ₙNHC(=O)(C(R⁴)₂)ₙ—, —(CH₂)ₙNH ((CH₂)ₙO)ₘ(CH₂)ₙ—, —(C(R⁴)₂)ₙNH((C(R⁴)₂)ₙO)ₘ (C(R⁴)₂)ₙ—, —(O(CH₂)ₙ)ₘNHC(=O)(CH₂)ₙ—, or —(O(C(R⁴)₂)ₙ)ₘNHC(=O)(C(R⁴)₂)ₙ—;

each X² is independently selected from a bond,

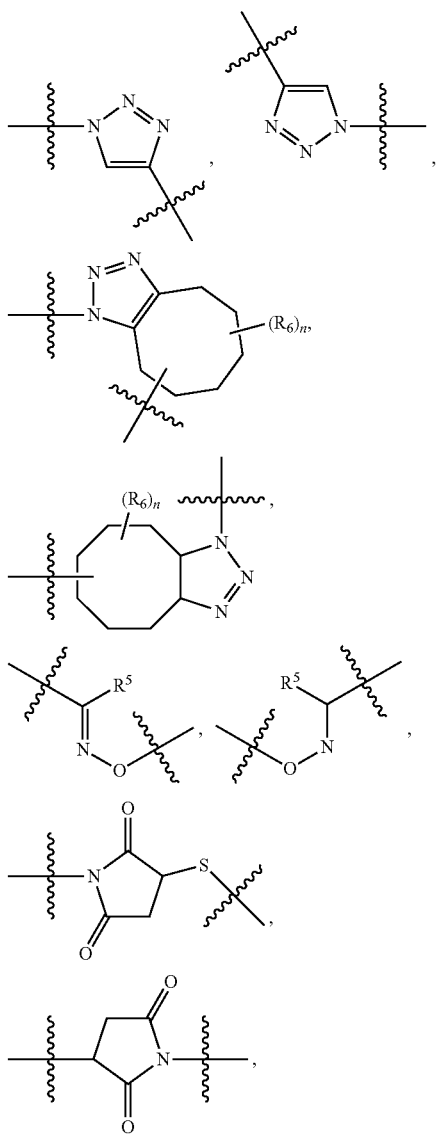

-continued
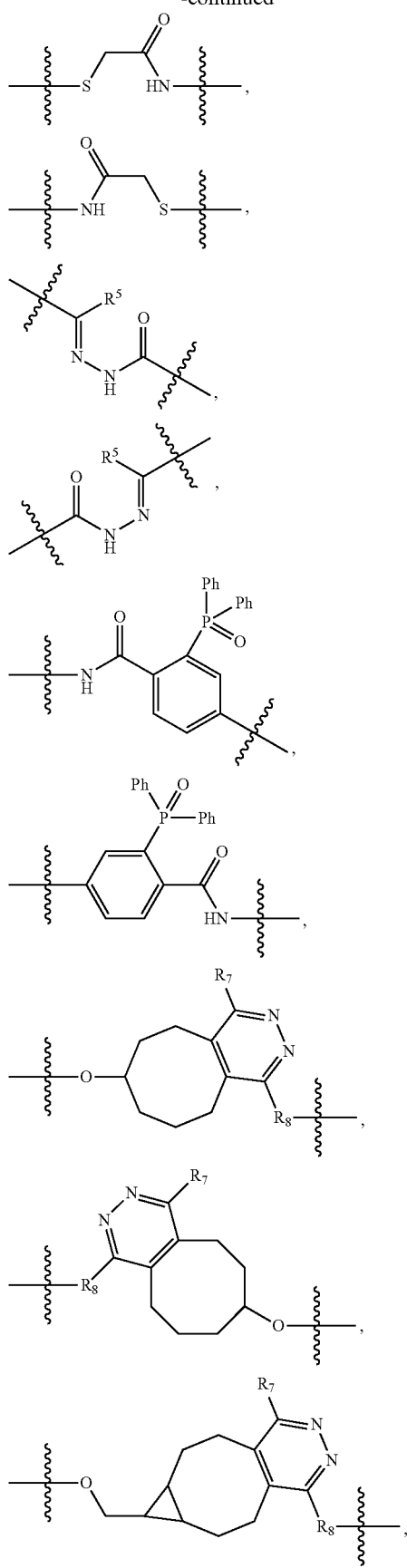
-continued
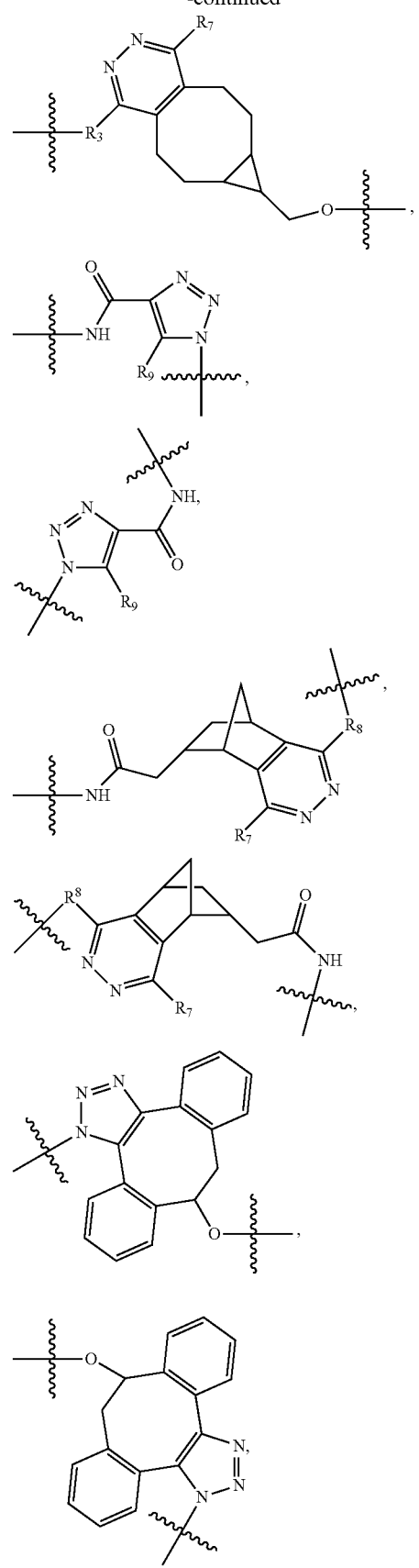

—S—, —Si(OH)₂O—,

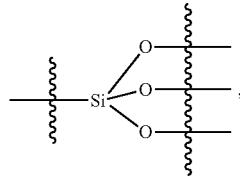

—CHR⁴(CH₂)ₙC(=O)NH—, —CHR⁴(CH₂)ₙNHC(=O)—, —C(=O)NH— and —NHC(=O)—;
each R⁴ is independently selected from H, C₁₋₄alkyl, —C(=O)OH and —OH,
each R⁵ is independently selected from H, C₁₋₄alkyl, phenyl or C₁₋₄alkyl substituted with 1 to 3 —OH groups;
each R⁶ is independently selected from H, fluoro, benzyloxy substituted with —C(=O)OH, benzyl substituted with —C(=O)OH, C₁₋₄alkoxy substituted with —C(=O)OH and C₁₋₄alkyl substituted with —C(=O)OH;
R⁷ is independently selected from H, phenyl and pyridine;
R⁸ is independently selected from

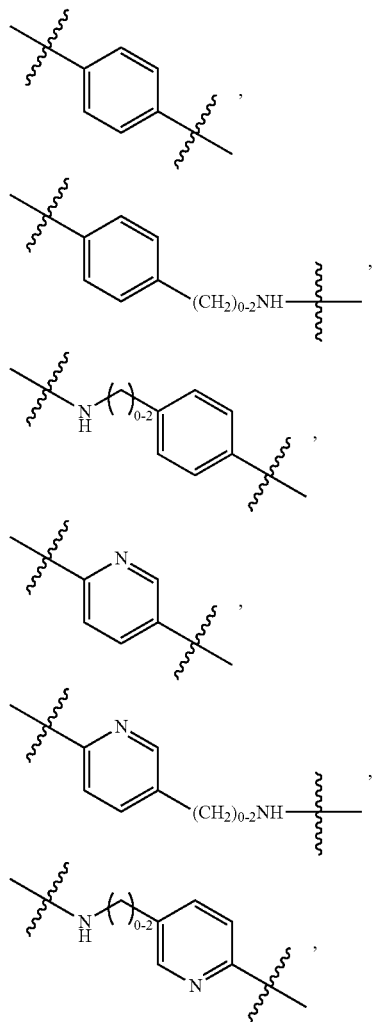

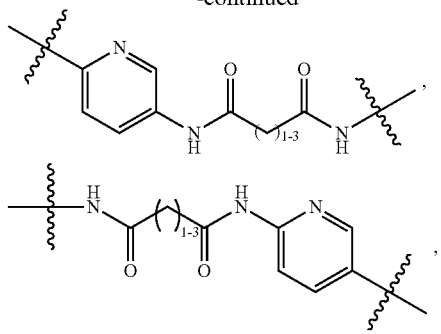

R⁹ is independently selected from H and C₁₋₆haloalkyl;
each n is independently selected from 1, 2, 3, 4, 5, 6, 7, 8 and 9,
each m is independently selected from 1, 2, 3, 4, 5, 6, 7, 8 and 9, and
R¹ is a thiol, a maleimide, a haloacetamide, an alkyne, a triaryl phosphine, a cyclooctene, an oxanobornadiene, an azide, a diaryl tetrazine, a norbornene, a monoaryl tetrazine, a hydroxylamine, a hydrazine, NH₂—NH—C(=O)—, an aldehyde or a ketone.

In certain embodiments of such conjugated antibodies or antibody fragments thereof, the 4'-phosphopantetheine group is

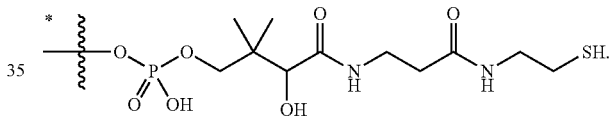

In certain embodiments of such conjugated antibodies or antibody fragments thereof, the conjugated serine has a structure selected from:

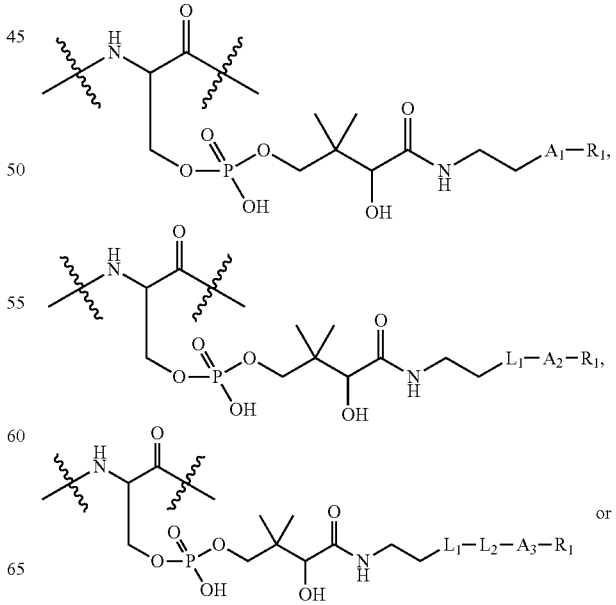

-continued

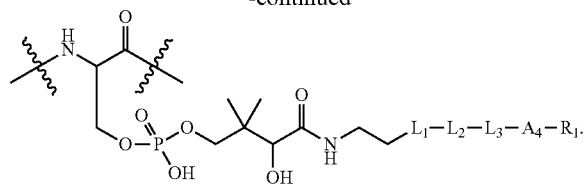

In other embodiments of such conjugated antibodies or antibody fragments thereof, the conjugated serine is

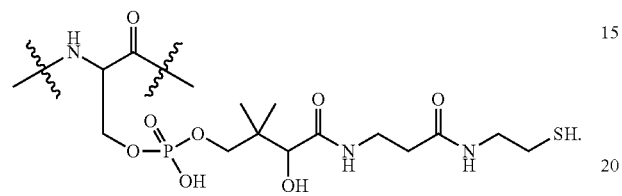

Another aspect provided herein are conjugated antibodies or antibody fragment thereof, comprising a modified antibody or antibody fragment thereof provided herein, wherein a serine residue of the peptide tag is conjugated to a modified 4'-phosphopantetheine group and the conjugated serine has a structure selected from:

wherein
$L_1$ is $-A_1X^2-$ or $-X^2-$;
$L_2$ is a bond, $-A_2-$, or $-A_2X^2-$;
$L_3$ is a bond, $-A_3-$, or $-A_3X^2-$;
$L_4$ is a bond, $-A_4-$, $-A_4X^2-$,

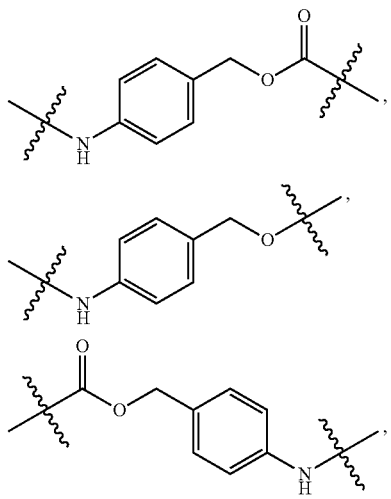

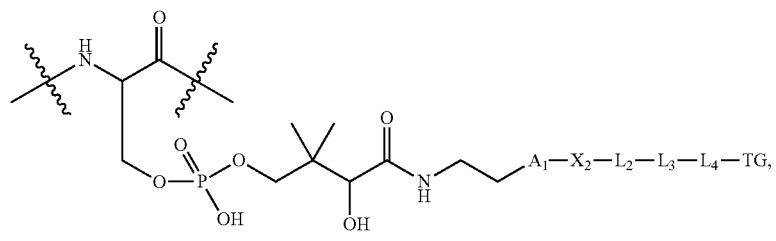

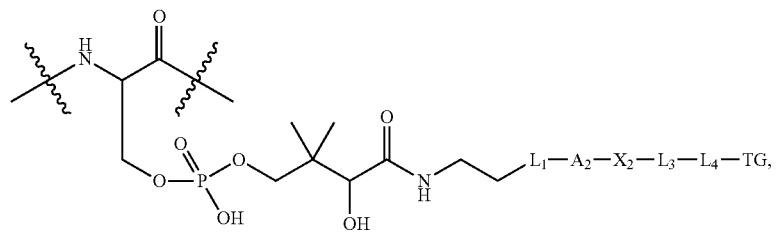

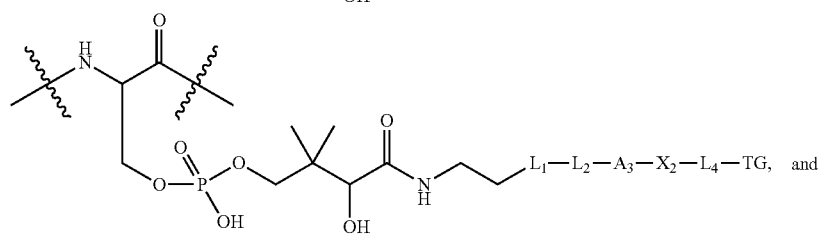

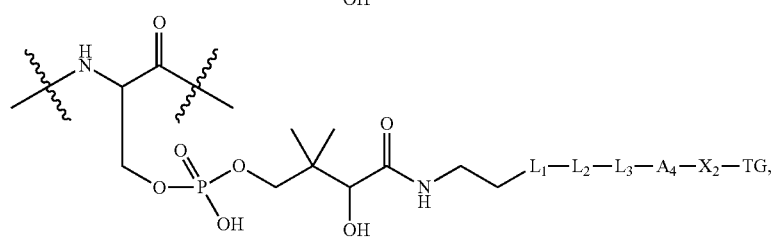

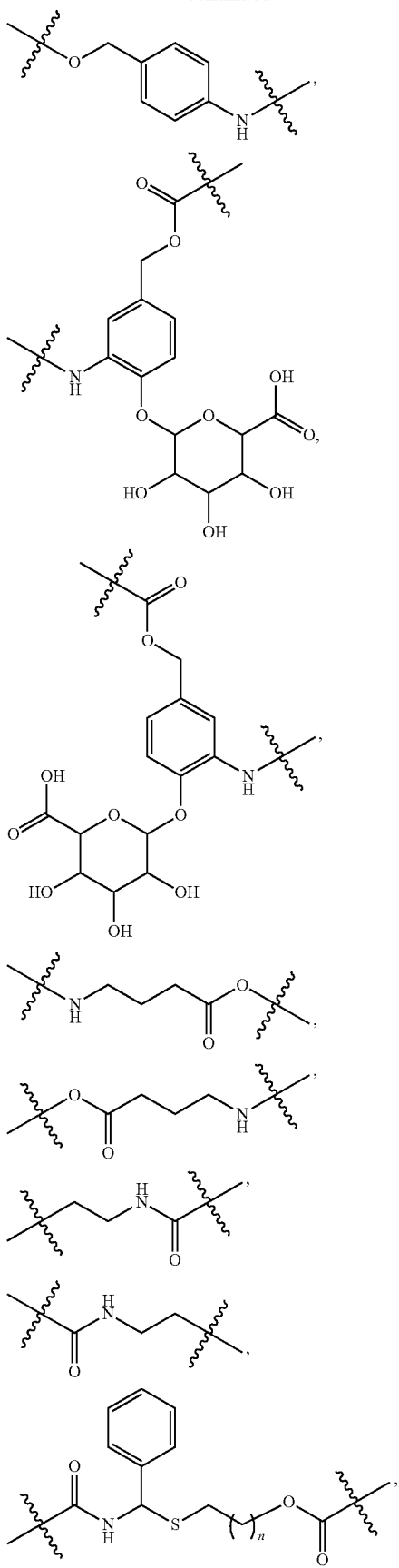

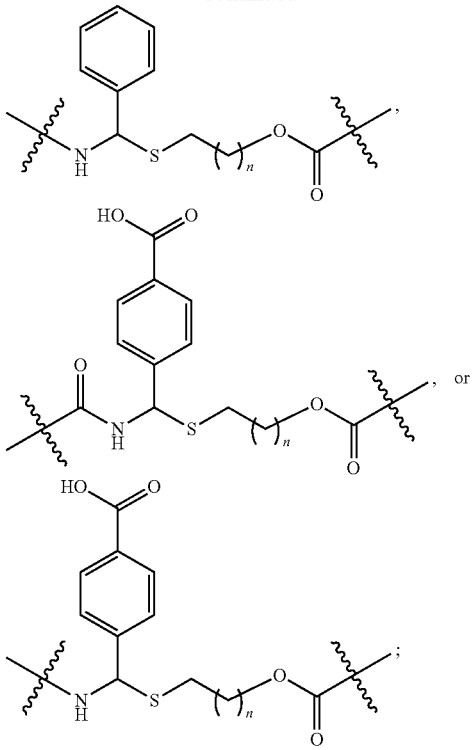

$A_1$ is —C(=O)NH—, —NHC(=O)—, —C(=O)NH($CH_2$)$_n$—, —C(=O)NH(C($R^4$)$_2$)$_n$—, —(O($CH_2$)$_n$)$_m$—, —(O(C($R^4$)$_2$)$_n$)$_m$—, —(($CH_2$)$_n$O)$_m$—, —(((C($R^4$)$_2$)$_n$O)$_m$—, —(($CH_2$)$_n$O)$_m$($CH_2$)$_n$—, —(((C($R^4$)$_2$)$_n$O)$_m$C($R^4$)$_2$)$_n$—, —($CH_2$)$_n$C(=O)NH—, —(C($R^4$)$_2$)$_n$C(=O)NH—, —($CH_2$)$_n$NHC(=O)—, —(C($R^4$)$_2$)$_n$NHC(=O)—, —NHC(=O)($CH_2$)$_n$—, —NHC(=O)(C($R^4$)$_2$)$_n$—, —C(=O)NH($CH_2$)$_n$S—, —C(=O)NH(C($R^4$)$_2$)$_n$S—, —S($CH_2$)$_n$C(=O)NH—, —S(C($R^4$)$_2$)$_n$C(=O)NH—, —C(=O)NH($CH_2$)$_n$NHC(=O)($CH_2$)$_n$—, —C(=O)NH(C($R^4$)$_2$)$_n$NHC(=O)(C($R^4$)$_2$)$_n$—, —C(=O)($CH_2$)$_n$—, —C(=O)(C($R^4$)$_2$)$_n$—, —($CH_2$)$_n$C(=O)—, —(C($R^4$)$_2$)$_n$C(=O)—, —($CH_2$)$_n$(O($CH_2$)$_n$)$_m$NHC(=O)($CH_2$)$_n$—, —(C($R^4$)$_2$)$_n$(O(C($R^4$)$_2$)$_n$)$_m$NHC(=O)(C($R^4$)$_2$)$_n$—, —($CH_2$)$_n$NHC(=O)($CH_2$)$_n$—, —(C($R^4$)$_2$)$_n$NHC(=O)(C($R^4$)$_2$)$_n$—, —($CH_2$)$_n$NH(($CH_2$)$_n$O)$_m$($CH_2$)$_n$—, —(C($R^4$)$_2$)$_n$NH((C($R^4$)$_2$)$_n$O)$_m$(C($R^4$)$_2$)$_n$—, —(O($CH_2$)$_n$)$_m$NHC(=O)($CH_2$)$_n$—, or —(O(C($R^4$)$_2$)$_n$)$_m$NHC(=O)(C($R^4$)$_2$)$_n$—;

$A_2$ is —C(=O)NH—, —C(=O)NH($CH_2$)$_n$—, —C(=O)NH(C($R^4$)$_2$)$_n$—, —(O($CH_2$)$_n$)$_m$—, —(O(C($R^4$)$_2$)$_n$)$_m$—, —(($CH_2$)$_n$O)$_m$—, —(((C($R^4$)$_2$)$_n$O)$_m$—, —(($CH_2$)$_n$O)$_m$($CH_2$)$_n$—, —(((C($R^4$)$_2$)$_n$O)$_m$C($R^4$)$_2$)$_n$—, —($CH_2$)$_n$C(=O)NH—, —(C($R^4$)$_2$)$_n$C(=O)N$R^4$—, —($CH_2$)$_n$NHC(=O)—, —(C($R^4$)$_2$)$_n$NHC(=O)—, —NHC(=O)($CH_2$)$_n$—, —NHC(=O)(C($R^4$)$_2$)$_n$—, —C(=O)NH($CH_2$)$_n$S—, —C(=O)NH(C($R^4$)$_2$)$_n$S—, —S($CH_2$)$_n$C(=O)NH—, —S(C($R^4$)$_2$)$_n$C(=O)NH—, —($CH_2$)$_n$S—, —(C($R^4$)$_2$)$_n$S—, —S($CH_2$)$_n$—, —S(C($R^4$)$_2$)$_n$—, —($CH_2$)$_n$NH—, —(C($R^4$)$_2$)$_n$NH—, —C(=O)NH($CH_2$)$_n$NHC(=O)($CH_2$)$_n$—, —C(=O)NH(C($R^4$)$_2$)$_n$NHC(=O)(C($R^4$)$_2$)$_n$—, —C(=O)($CH_2$)$_n$—, —C(=O)(C($R^4$)$_2$)$_n$—, —($CH_2$)$_n$C(=O)—, —(C($R^4$)$_2$)$_n$C(=O)—, —($CH_2$)$_n$(O($CH_2$)$_n$)$_m$NHC(=O)($CH_2$)$_n$—, —(C($R^4$)$_2$)$_n$(O(C($R^4$)$_2$)$_n$)$_m$NHC(=O)

—(C(R⁴)₂)ₙ—, —(CH₂)ₙ(O(CH₂)ₙ)ₘC(=O)NH(CH₂)ₙ—, —(C(R⁴)₂)ₙ(O(C(R⁴)₂)ₙ)ₘOC(=O)NH(C(R⁴)₂)ₙ—, —(CH₂)ₙNHC(=O)(CH₂)ₙ—, —(C(R⁴)₂)ₙNHC(=O)(C(R⁴)₂)ₙ—, —(CH₂)ₙNH((CH₂)ₙO)ₘ(CH₂)ₙ—, —(C(R⁴)₂)ₙNH((C(R⁴)₂)ₙO)ₘ(C(R⁴)₂)ₙ—, —(O(CH₂)ₙ)ₘNHC(=O)(CH₂)ₙ—, —(O(C(R⁴)₂)ₙ)ₘNHC(=O)(C(R⁴)₂)ₙ—,

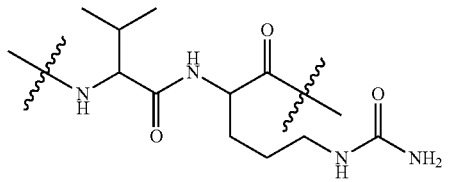

or

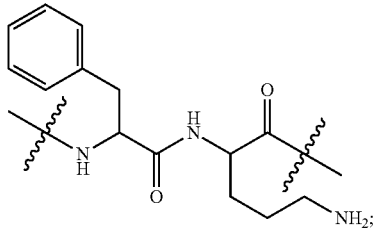

$A_3$ is —C(=O)NH—, —C(=O)NH(CH₂)ₙ—, —C(=O)NH(C(R⁴)₂)ₙ—, —(O(CH₂)ₙ)ₘ—, —(O(C(R⁴)₂)ₙ)ₘ—, —((CH₂)ₙO)ₘ—, —(((C(R⁴)₂)ₙO)ₘ—, —((CH₂)ₙO)ₘ(CH₂)ₙ—, —(((C(R⁴)₂)ₙO)ₘ(C(R⁴)₂)ₙ—, —(CH₂)ₙC(=O)NH—, —(C(R⁴)₂)ₙC(=O)NH—, —(CH₂)ₙNHC(=O)—, —(C(R⁴)₂)ₙNHC(=O)—, —NHC(=O)(CH₂)ₙ—, —NHC(=O)(C(R⁴)₂)ₙ—, —C(=O)NH(CH₂)ₙS—, —C(=O)NH(C(R⁴)₂)ₙS—, —S(CH₂)ₙC(=O)NH—, —S(C(R⁴)₂)ₙC(=O)NH—, —(CH₂)ₙS—, —(C(R⁴)₂)ₙS—, —S(CH₂)ₙ—, —S(C(R⁴)₂)ₙ—, —C(=O)NH(CH₂)ₙNHC(=O)(CH₂)ₙ—, —C(=O)NH(C(R⁴)₂)ₙNHC(=O)(C(R⁴)₂)ₙ—, —C(=O)(CH₂)ₙ—, —C(=O)(C(R⁴)₂)ₙ—, —(CH₂)ₙC(=O)—, —(C(R⁴)₂)ₙC(=O)—, —(CH₂)ₙ(O(CH₂)ₙ)ₘNHC(=O)(CH₂)ₙ—, —(C(R⁴)₂)ₙ(O(C(R⁴)₂)ₙ)ₘNHC(=O)(C(R⁴)₂)ₙ—, —(CH₂)ₙ(O(CH₂)ₙ)ₘOC(=O)NH(CH₂)ₙ—, —(C(R⁴)₂)ₙ(O(C(R⁴)₂)ₙ)ₘOC(=O)NH(C(R⁴)₂)ₙ—, —(CH₂)ₙ(O(CH₂)ₙ)ₘOC(=O)—, —(C(R⁴)₂)ₙ(O(C(R⁴)₂)ₙ)ₘC(=O)—, —(CH₂)ₙ(O(CH₂)ₙ)ₘC(=O)—, —(C(R⁴)₂)ₙ(O(C(R⁴)₂)ₙ)ₘC(=O)—, —(CH₂)ₙNHC(=O)(CH₂)ₙ—, —(C(R⁴)₂)ₙNHC(=O)(C(R⁴)₂)ₙ—, —(O(CH₂)ₙ)ₘNHC(=O)(CH₂)ₙ—, —(O(C(R⁴)₂)ₙ)ₘNHC(=O)(C(R⁴)₂)ₙ—,

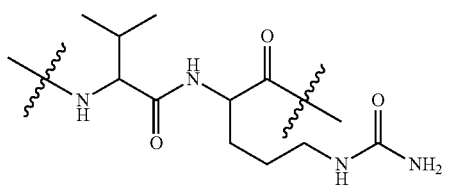

or

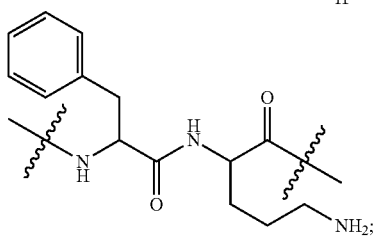

$A_4$ is —C(=O)NH—, —C(=O)NH(CH₂)ₙ—, —C(=O)NH(C(R⁴)₂)ₙ—, —(O(CH₂)ₙ)ₘ—, —(O(C(R⁴)₂)ₙ)ₘ—, —((CH₂)ₙO)ₘ—, —(((C(R⁴)₂)ₙO)ₘ—, —((CH₂)ₙO)ₘ(CH₂)ₙ—, —(((C(R⁴)₂)ₙO)ₘ(C(R⁴)₂)ₙ—, —(CH₂)ₙC(=O)NH—, —(C(R⁴)₂)ₙC(=O)NH—, —(CH₂)ₙNHC(=O)—, —(C(R⁴)₂)ₙNHC(=O)—, —NHC(=O)(CH₂)ₙ—, —NHC(=O)(C(R⁴)₂)ₙ—, —C(=O)NH(CH₂)ₙS—, —C(=O)NH(C(R⁴)₂)ₙS—, —S(CH₂)ₙC(=O)NH—, —S(C(R⁴)₂)ₙC(=O)NH—, —C(=O)NH(CH₂)ₙNHC(=O)(CH₂)ₙ—, —C(=O)NH(C(R⁴)₂)ₙNHC(=O)(C(R⁴)₂)ₙ—, —C(=O)(CH₂)ₙ—, —C(=O)(C(R⁴)₂)ₙ—, —(CH₂)ₙC(=O)—, —(C(R⁴)₂)ₙC(=O)—, —(CH₂)ₙ(O(CH₂)ₙ)ₘNHC(=O)(CH₂)ₙ—, —(C(R⁴)₂)ₙ(O(C(R⁴)₂)ₙ)ₘNHC(=O)(C(R⁴)₂)ₙ—, —(CH₂)ₙNHC(=O)(CH₂)ₙ—, —(C(R⁴)₂)ₙNHC(=O)(C(R⁴)₂)ₙ—, —(CH₂)ₙNH((CH₂)ₙO)ₘ(CH₂)ₙ—, —(C(R⁴)₂)ₙNH((C(R⁴)₂)ₙO)ₘ(C(R⁴)₂)ₙ—, —(O(CH₂)ₙ)ₘNHC(=O)(CH₂)ₙ—, or —(O(C(R⁴)₂)ₙ)ₘNHC(=O)(C(R⁴)₂)ₙ—;

each $X^2$ is independently selected from a bond,

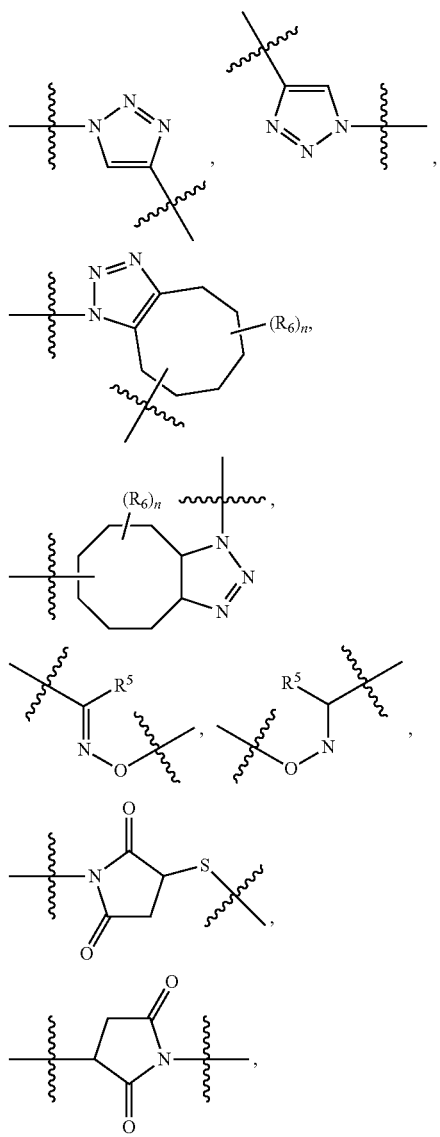

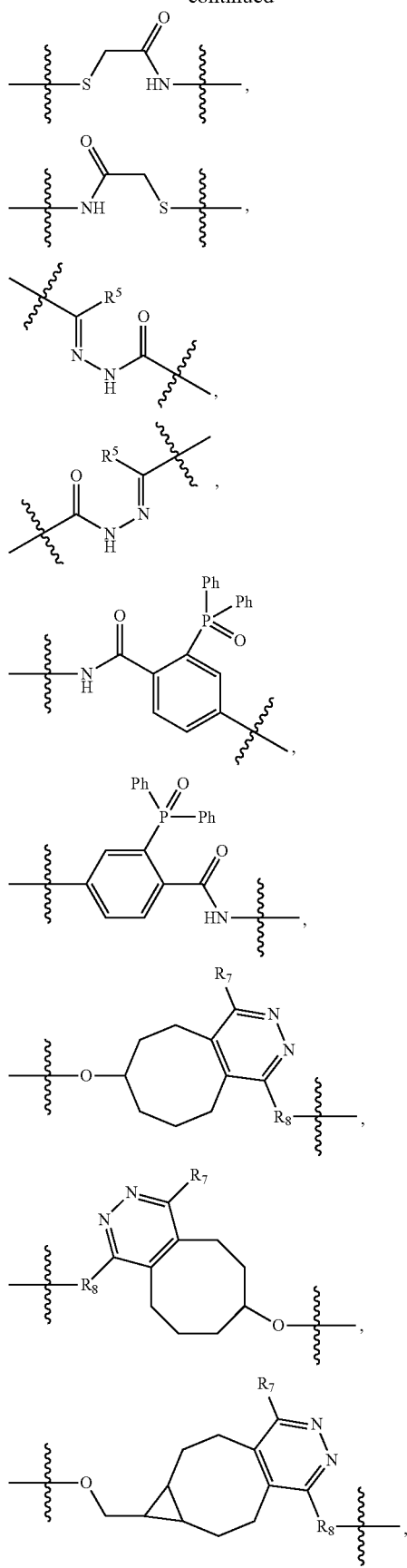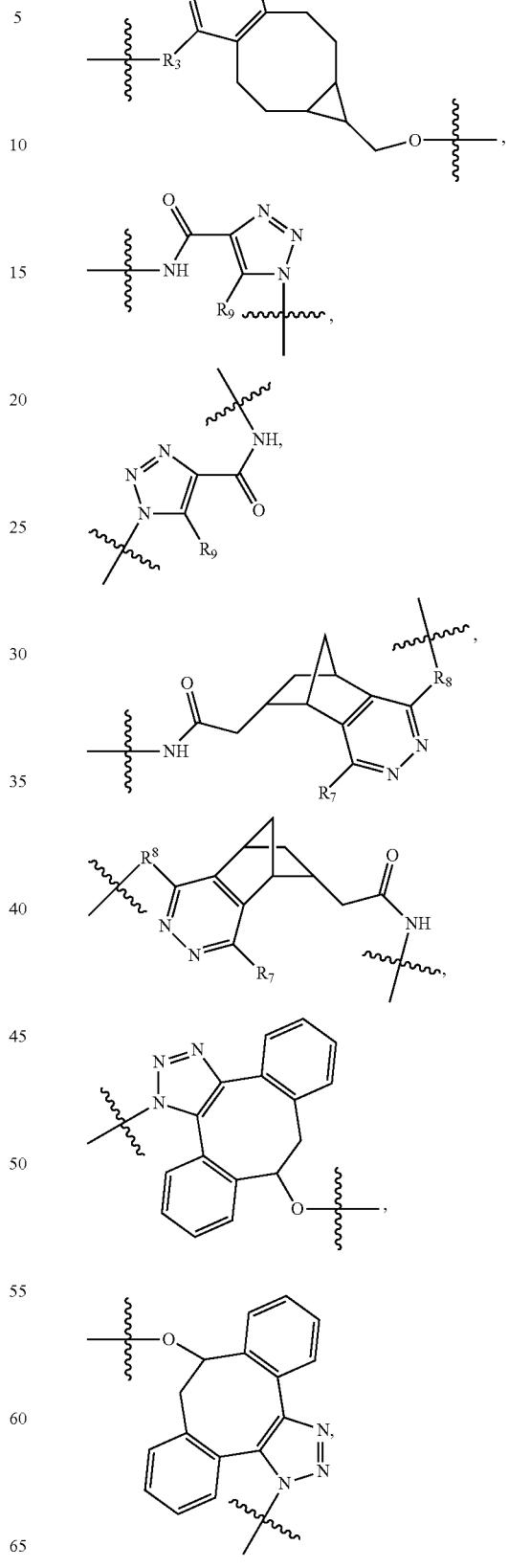

—S—, —Si(OH)$_2$O—,

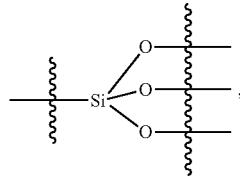

—CHR$^4$(CH$_2$)$_n$C(=O)NH—, —CHR$^4$(CH$_2$)$_n$NHC(=O)—, —C(=O)NH— and —NHC(=O)—;

each R$^4$ is independently selected from H, C$_{1-4}$alkyl, —C(=O)OH and —OH, each R$^5$ is independently selected from H, C$_{1-4}$alkyl, phenyl or C$_{1-4}$alkyl substituted with 1 to 3 —OH groups;

each R$^6$ is independently selected from H, fluoro, benzyloxy substituted with —C(=O)OH, benzyl substituted with —C(=O)OH, C$_{1-4}$alkoxy substituted with —C(=O)OH and C$_{1-4}$alkyl substituted with —C(=O)OH;

R$^7$ is independently selected from H, phenyl and pyridine;

R$^8$ is independently selected from

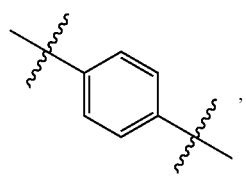

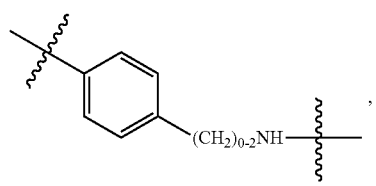

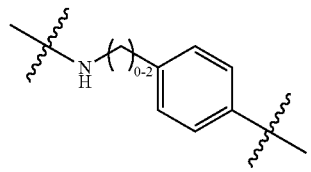

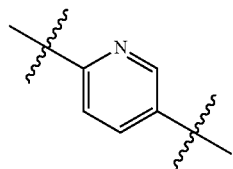

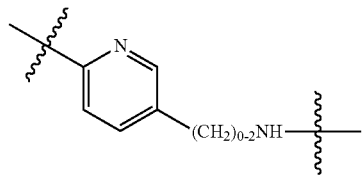

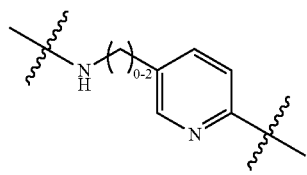

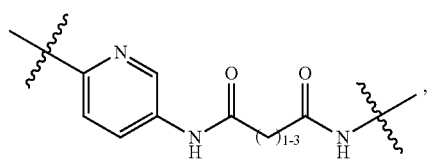

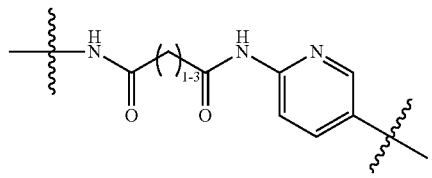

R$^9$ is independently selected from H and C$_{1-6}$haloalkyl;

each n is independently selected from 1, 2, 3, 4, 5, 6, 7, 8 and 9, each m is independently selected from 1, 2, 3, 4, 5, 6, 7, 8 and 9, and TG is a drug moiety, an affinity probe, a chelator, a spectroscopic probe, a radioactive probe, an imaging reagent, a lipid molecule, a polyethylene glycol, a polymer, a nanoparticle, a quantum dot, a liposome, a PLGA particle, a polysaccharide, an acetyl group, or a surface.

In certain embodiments of such conjugated antibodies or antibody fragments thereof, the conjugated serine is

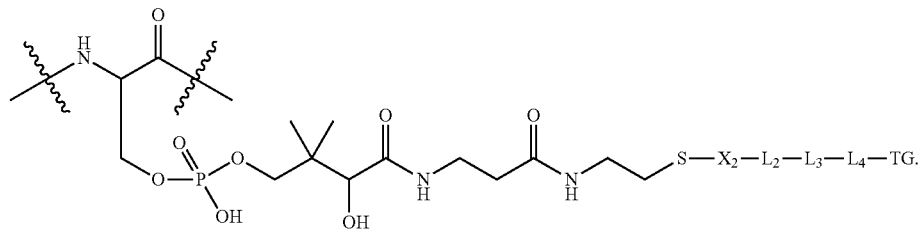

of such conjugated antibodies or antibody fragments thereof, $X_2$ is

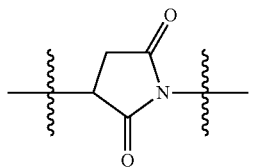 [SMILES: *C1CC(=O)N(*)C1=O]

or —$(CH_2)C(=O)NH$—.

The present invention also provides pharmaceutical compositions comprising an effective amount of the immunoconjugate of the invention, or a pharmaceutically acceptable salt thereof, and a pharmaceutically acceptable diluent, carrier or excipient.

The present invention provides a method of treating a disease, such as cancer, comprising administering to a mammal in need thereof an effective amount of an immunoconjugate of the invention. In some embodiments, the present invention provides immunoconjugates for use as a medicament. In some embodiments, the present invention provides use of an immunoconjugate in the manufacture of a medicament for treatment of cancer, autoimmune diseases, inflammatory diseases, infectious diseases (e.g., bacterial, fungus, virus), genetic disorders, cardiovascular diseases, and/or metabolic diseases.

The present invention provides methods of producing the immunoconjugates described herein. In one embodiment, the method comprises incubating the modified antibody or antibody fragment of invention, a 4'-phosphopantetheinyl transferase, and a terminal group linked to CoA under suitable conditions to promote formation of an immunoconjugate comprising the antibody or antibody fragment and the terminal group linked together by 4'-phosphopantetheine. In a specific embodiment, the suitable condition comprises a temperature between 4° C. to 37° C. and pH 6.5 to pH 9.0.

DEFINITIONS

The terms "alkenyl" or "alkene", as used herein, refer to a branched or straight chain hydrocarbon having at least one carbon-carbon double bond. Atoms oriented about the double bond are in either the cis (Z) or trans (E) conformation. As used herein, the terms "$C_2$-$C_4$alkenyl", "$C_2$-$C_5$alkenyl", "$C_2$-$C_6$alkenyl", "$C_2$-$C_7$alkenyl", "$C_2$-$C_8$alkenyl", "$C_2$-$C_4$alkene", "$C_2$-$C_5$alkene", "$C_2$-$C_6$alkene", "$C_2$-$C_7$alkene", and "$C_2$-$C_8$alkene" refer to a branched or straight chain hydrocarbon having at least one carbon-carbon double bond and containing at least 2, and at most 4, 5, 6, 7 or 8 carbon atoms, respectively. Non-limiting examples of alkenyl groups, as used herein, include ethenyl, ethane, epropenyl, propene, allyl (2-propenyl), 2-propene, butenyl, pentenyl, pentene, hexenyl, heptenyl, heptene, octenyl, nonenyl, nonene, decenyl, decene and the like. If not otherwise specified, an alkenyl group generally is a $C_2$-$C_6$ alkenyl.

The terms "alkynyl" or "alkyne", as used herein, refer to a branched or straight chain hydrocarbon radical having at least one carbon-carbon triple bond. As used herein, the terms "$C_2$-$C_4$alkynyl", "$C_2$-$C_5$alkynyl", "$C_2$-$C_6$alkynyl", "$C_2$-$C_7$alkynyl", and "$C_2$-$C_8$alkynyl" refer to a branched or straight chain hydrocarbon radical having at least one carbon-carbon triple bond and containing at least 2, and at most 4, 5, 6, 7 or 8 carbon atoms, respectively. Non-limiting examples of alkynyl groups, as used herein, include ethynyl, propynyl, butynyl, pentynyl, hexynyl, heptynyl, octynyl, nonynyl, decynyl and the like. If not otherwise specified, an alkynyl group generally is a $C_2$-$C_6$ alkynyl.

The term "alkyl," as used herein, refers to a saturated branched or straight chain hydrocarbon. As used herein, the terms "$C_1$-$C_3$alkyl", "$C_1$-$C_4$alkyl", "$C_1$-$C_5$alkyl", "$C_1$-$C_6$alkyl", "$C_1$-$C_7$alkyl" or "$C_1$-$C_8$alkyl" refer to saturated branched or straight chain hydrocarbon containing at least 1, and at most 3, 4, 5, 6, 7 or 8 carbon atoms, respectively. Non-limiting examples of alkyl groups as used herein include methyl, ethyl, n-propyl, isopropyl, n-butyl, isobutyl, sec-butyl, t-butyl, n-pentyl, isopentyl, hexyl, heptyl, octyl, nonyl, decyl and the like. If not otherwise specified, an alkyl group generally is a $C_1$-$C_6$ alkyl.

The term "alkoxy," as used herein, refers to the group —$OR_a$, where $R_a$ is an alkyl group as defined herein. As used herein, the terms "$C_1$-$C_3$alkoxy", "$C_1$-$C_4$alkoxy", "$C_1$-$C_5$alkoxy", "$C_1$-$C_6$alkoxy", "$C_1$-$C_7$alkoxy" and "$C_1$-$C_8$alkoxy" refer to an alkoxy group wherein the alkyl moiety contains at least 1, and at most 3, 4, 5, 6, 7 or 8, carbon atoms. Non-limiting examples of alkoxy groups, as used herein, include methoxy, ethoxy, n-propoxy, isopropoxy, n-butyloxy, t-butyloxy, pentyloxy, hexyloxy, heptyloxy, octyloxy, nonyloxy, decyloxy and the like.

The term "aryl", as used herein, refers to monocyclic, bicyclic, and tricyclic ring systems having a total of six to fourteen ring members, wherein at least one ring in the system is aromatic. An aryl group also includes one or more aromatic rings fused to one or more non-aromatic hydrocarbon rings. Non-limiting examples of aryl groups, as used herein, include phenyl (Ph), naphthyl, fluorenyl, indenyl, azulenyl, anthracenyl and the like. An aryl group may contain one or more substituents and thus may be "optionally substituted". Unless otherwise specified, aryl groups can have up to four substituents.

The term "cycloalkyl", as used herein, refers to a saturated monocyclic, fused bicyclic, fused tricyclic or bridged polycyclic ring assembly. As used herein, the terms "$C_3$-$C_5$cycloalkyl", "$C_3$-$C_6$cycloalkyl", "$C_3$-$C_7$cycloalkyl", "$C_3$-$C_8$cycloalkyl, "$C_3$-$C_9$cycloalkyl and "$C_3$-$C_{10}$cycloalkyl refer to a saturated monocyclic, fused bicyclic, fused tricyclic or bridged polycyclic ring assembly which contains at least 3, and at most 5, 6, 7, 8, 9 or 10, carbon atoms. Non-limiting examples of cycloalkyl groups, as used herein, include cyclopropyl, cyclobutyl, cyclopentyl, cyclohexyl, cycloheptyl, cyclooctyl, cyclononyl, cyclodecyl, decahydronaphthalenyl and the like. If not otherwise specified, a cycloalkyl group generally is a $C_3$-$C_8$ cycloalkyl.

The terms "cycloalkenyl" or "cycloalkene", as used herein, refers to a monocyclic, fused bicyclic, fused tricyclic or bridged polycyclic ring assembly having at least one carbon-carbon double bond. Atoms oriented about the double bond are in either the cis (Z) or trans (E) conformation. A monocyclic cycloalkene can be fused to one or two aryl rings. Non-limiting examples of cycloalkenyl groups, as used herein, include cyclopropenyl, cyclobutenyl, cyclopentenyl, cyclohexenyl, cycloheptenyl, cyclooctenyl, cyclononenyl, cyclodecenyl, and the like. If not otherwise specified, a cycloalkenyl group generally is a $C_5$-$C_8$ cycloalkenyl.

The terms "cycloalkynyl" or "cycloalkyne", as used herein, refers to a monocyclic, fused bicyclic, fused tricyclic or bridged polycyclic ring assembly having at least one carbon-carbon triple bond. A monocyclic cycloalkyne can be fused to one or two aryl rings. Non-limiting examples of cycloalkynyl groups, as used herein, include cyclopropynyl, cyclobutynyl, cyclopentynyl, cyclohexynyl, cycloheptynyl, cyclooctynyl, cyclononynyl, cyclodecynyl, and the like. If not otherwise specified, a cycloalkynyl group generally is a $C_6$-$C_8$ cycloalkynyl.

The term "heteroaryl," as used herein, refers to a 5-6 membered heteroaromatic monocyclic ring having 1 to 4 heteroatoms independently selected from nitrogen, oxygen and sulfur, an 8-10 membered fused bicyclic ring having 1 to 4 heteroatoms independently selected from nitrogen, oxygen and sulfur as ring members and where at least one of the rings is aromatic, or a 12-14 membered fused tricyclic ring having 1 to 4 heteroatoms independently selected from nitrogen, oxygen and sulfur and where at least one of the rings is aromatic. Such fused bicyclic and tricyclic ring systems may be fused to one or more aryl, cycloalkyl, or heterocycloalkyl rings. Non-limiting examples of heteroaryl groups, as used herein, include 2- or 3-furyl; 1-, 2-, 4-, or 5-imidazolyl; 3-, 4-, or 5-isothiazolyl; 3-, 4-, or 5-isoxazolyl; 2-, 4-, or 5-oxazolyl; 4- or 5-1,2,3-oxadiazolyl; 2- or 3-pyrazinyl; 1-, 3-, 4-, or 5-pyrazolyl; 3-, 4-, 5- or 6-pyridazinyl; 2-, 3-, or 4-pyridyl; 2-, 4-, 5- or 6-pyrimidinyl; 1-, 2- or 3-pyrrolyl; 1- or 5-tetrazolyl; 2- or 5-1,3,4-thiadiazolyl; 2-, 4-, or 5-thiazolyl; 2- or 3-thienyl; 2-, 4- or 6-1,3,5-triazinyl; 1-, 3- or 5-1,2,4-triazolyl; 1-, 4- or 5-1,2,3-triazolyl; 1-, 2-, 3-, 4-, 5-, 6-, 7-, 8-, or 9-acridinyl; 1-, 3-, 4-, 5-, 6-, 7-, 8-, 9-, or 10-benzo[g]isoquinoline; 2-, 4-, 5-, 6-, or 7-benzoxazolyl; 1-, 2-, 4-, 5-, 6-, or 7-benzimidazolyl; 2-, 4-, 5-, 6-, or 7-benzothiazolyl; 2-, 3-, 4-, 5-, 6-, 7-benzo[b]thienyl; 2-, 3-, 4-, 5-, 6-, 7-, 8-, 9-benzo[b]oxepine; 2-, 4-, 5-, 6-, 7-, or 8-benzoxazinyl; 1-, 2-, 3-, 4-, 5-, 6-, 7-, 8, or 9-carbazolyl; 3-, 4-, 5-, 6-, 7-, or 8-cinnolinyl; 2-, 4-, or 5-4H-imidazo[4,5-d]thiazolyl; 2-, 3-, 5-, or 6-imidazo[2,1-b]thiazolyl; 2-, 3-, 6-, or 7-imidazo[1,2-b][1,2,4]triazinyl; 1-, 3-, 4-, 5-, 6-, or 7-indazolyl; 1-, 2-, 3-, 5-, 6-, 7-, or 8-indolizinyl; 1-, 2-, 3-, 4-, 5-, 6-, or 7-indolyl; 1-, 2-, 3-, 4-, 5-, 6-, or 7-isoindolyl; 1-, 3-, 4-, 5-, 6-, 7-, or 8-isoquinoliyl; 2-, 3-, 4-, 5-, 6-, or 7-naphthyridinyl; 1-, 2-, 4-, 5-, 6-, 7-, 8-, or 9-perimidinyl; 1-, 2-, 3-, 4-, 6-, 7-, 8-, 9-, or 10-phenanthridinyl; 1-, 2-, 3-, 4- , 5-, 6-, 7-, 8-, 9-, or 10-phenathrolinyl; 1-, 2-, 3-, 4-, 6-, 7-, 8-, or 9-phenazinyl; 1-, 2-, 3-, 4-, 6-, 7-, 8-, 9-, or 10-phenothiazinyl; 1-, 2-, 3-, 4-, 6-, 7-, 8-, 9-, or 10-phenoxazinyl; 1-, 4-, 5-, 6-, 7-, or 8-phthalazinyl; 2-, 4-, 6-, or 7-pteridinyl; 2-, 6-, 7-, or 8-purinyl; 2-, 3-, 5-, 6-, 7-, 8-, 9-, 10-, or 11-7H-pyrazino[2,3-c]carbazolyl; 2-, 3-, 5-, 6-, or 7-furo[3,2-b]-pyranyl; 1-, 3-, or 5-1H-pyrazolo[4,3-d]-oxazolyl; 2-, 3-, 5-, or 8-pyrazino[2,3-d]pyridazinyl; 1-, 2-, 3-, 4-, 5-, or 8-5H-pyrido[2,3-d]-o-oxazinyl; 1-, 2-, 3-, 4-, 6-, 7-, 8-, or 9-quinolizinyl; 2-, 3-, 4-, 5-, 6-, 7-, or 8-quinolinyl; 2-, 3-, 4-, 5-, 6-, 7-, or 8-quinazolinyl; 2-, 3-, 4-, or 5-thieno[2,3-b]furanyl, and 1-, 3-, 6-, 7-, 8-, or 9-furo[3,4-c]cinnolinyl.

The term "heteroatoms," as used herein, refers to nitrogen (N), oxygen (O) or sulfur (S) atoms.

The term "heterocycloalkyl," as used herein refers to a to saturated 3-8 membered monocyclic hydrocarbon ring structure, a saturated 6-9 membered fused bicyclic hydrocarbon ring structure, or a saturated 10-14 membered fused tricyclic hydrocarbon ring structure, wherein one to four of the ring carbons of the hydrocarbon ring structure are replaced by one to four groups independently selected from —O—, —NR—, and —S—, wherein R is hydrogen, $C_1$-$C_4$alkyl or an amino protecting group. Non-limiting examples of heterocycloalkyl groups, as used herein, include aziridinyl, aziridin-1-yl, aziridin-2-yl, aziridin-3-yl, oxiranyl, oxiran-2-yl, oxiran-3-yl, thiiranyl, thiiran-2-yl, thiiran-3-yl, azetadinyl, azetadin-1-yl, azetadin-2-yl, azetadin-3-yl, oxetanyl, oxetan-2-yl, oxetan-3-yl, oxetan-4-yl, thietanyl, thietan-2-yl, thietan-3-yl, thietan-4-yl, pyrrolidinyl, pyrrolidin-1-yl, pyrrolidin-2-yl, pyrrolidin-3-yl, pyrrolidin-4-yl, pyrrolidin-5-yl, tetrahydrofuranyl, tetrahydrofuran-2-yl, tetrahydrofuran-3-yl, tetrahydrofuran-4-yl, tetrahydrofuran-5-yl, tetrahydrothienyl, tetrahydrothien-2-yl, tetrahydrothien-3-yl, tetrahydrothien-4-yl, tetrahydrothien-5-yl, piperidinyl, piperidin-1-yl, piperidin-2-yl, piperidin-3-yl, piperidin-4-yl, piperidin-5-yl, piperidin-6-yl, tetrahydropyranyl, tetrahydropyran-2-yl, tetrahydropyran-3-yl, tetrahydropyran-4-yl, tetrahydropyran-5-yl, tetrahydropyran-6-yl, tetrahydrothiopyranyl, tetrahydrothiopyran-2-yl, tetrahydrothiopyran-3-yl, tetrahydrothiopyran-4-yl, tetrahydrothiopyran-5-yl, tetrahydrothiopyran-6-yl, piperazinyl, piperazin-1-yl, piperazin-2-yl, piperazin-3-yl, piperazin-4-yl, piperazin-5-yl, piperazin-6-yl, morpholinyl, morpholin-2-yl, morpholin-3-yl, morpholin-4-yl, morpholin-5-yl, morpholin-6-yl, thiomorpholinyl, thiomorpholin-2-yl, thiomorpholin-3-yl, thiomorpholin-4-yl, thiomorpholin-5-yl, thiomorpholin-6-yl, oxathianyl, oxathian-2-yl, oxathian-3-yl, oxathian-5-yl, oxathian-6-yl, dithianyl, dithian-2-yl, dithian-3-yl, dithian-5-yl, dithian-6-yl, azepanyl, azepan-1-yl, azepan-2-yl, azepan-3-yl, azepan-4-yl, azepan-5-yl, azepan-6-yl, azepan-7-yl, oxepanyl, oxepan-2-yl, oxepan-3-yl, oxepan-4-yl, oxepan-5-yl, oxepan-6-yl, oxepan-7-yl, thiepanyl, thiepan-2-yl, thiepan-3-yl, thiepan-4-yl, thiepan-5-yl, thiepan-6-yl, thiepan-7-yl, dioxolanyl, dioxolan-2-yl, dioxolan-4-yl, dioxolan-5-yl, thioxanyl, thioxan-2-yl, thioxan-3-yl, thioxan-4-yl, thioxan-5-yl, dithiolanyl, dithiolan-2-yl, dithiolan-4-yl, dithiolan-5-yl, pyrrolinyl, pyrrolin-1-yl, pyrrolin-2-yl, pyrrolin-3-yl, pyrrolin-4-yl, pyrrolin-5-yl, imidazolinyl, imidazolin-1-yl, imidazolin-3-yl, imidazolin-4-yl, imidazolin-5-yl, imidazolidinyl, imidazolidin-1-yl, imidazolidin-2-yl, imidazolidin-3-yl, imidazolidin-4-yl, imidazolidin-4-yl, pyrazolinyl, pyrazolin-1-yl, pyrazolin-3-yl, pyrazolin-4-yl, pyrazolin-5-yl, pyrazolidinyl, pyrazolidin-1-yl, pyrazolidin-2-yl, pyrazolidin-3-yl, pyrazolidin-4-yl, pyrazolidin-5-yl, hexahydro-1,4-diazepinyl, dihydrofuranyldihydropyranyl, 1,2,3,6-tetrahydropyridinyl, 2H-pyranyl, 4H-pyranyl, dihydropyranyl, dihydrothienyl, dihydrofuranyl, 3-azabicyclo[3.1.0]hexanyl, 3-azabicyclo[4.1.0]heptanyl, pyrrolidinyl-2-one, piperidinyl-3-one piperidinyl-2-one, piperidinyl-4-one, and 2H-pyrrolyl.

The term "optionally substituted", as used herein, means that the referenced group may or may not be substituted with one or more additional group(s) in place of one or more hydrogen atoms of the unsubstituted group. The number of such groups that can be present ranges from one up to the number of hydrogen atoms on the unsubstituted group. The optional substituents, unless otherwise specified, are individually and independently selected from alkyl, alkenyl, alkynyl, cycloalkyl, aryl, heteroaryl, heterocycloalkyl, hydroxyl, alkoxy, mercaptyl, cyano, halo, carbonyl, thiocarbonyl, isocyanate, thiocyanato, isothiocyanato, nitro, perhaloalkyl, perfluoroalkyl, and amino, including mono- and di-substituted amino groups, and the protected derivatives thereof. Non-limiting examples of optional substituents include, halo (particularly F, Cl and Br), —CN, —OR, —R, —$NO_2$, —C(=O)R, —OC(=O)R, —C(=O)OR, —OC(=O)NHR, —C(=O)N(R)$_2$, —SR—, —S(=O)R, —S(=O)$_2$R, —NHR, —N(R)$_2$, —NHC(=O)R, —NRC(=O)R, —NRC(S)R, NHC(=O)OR, —NRCO$_2$R, —NRC(=O)N(R)$_2$, —NRC(S)N(R)$_2$, —NRNRC(=O)R, —NRNRC(=O)N(R)$_2$, —NRNRCO$_2$R, —C(=O)NH—, S(=O)$_2$NHR, —S(=O)$_2$N(R)$_2$, —NHS(=O)$_2$, —NHS(=O)$_2$R, —C(=O)C(=O)R, —C(=O)CH$_2$C(=O)R, —C(S)R, —C(=O)N(R)$_2$, —C(S)N(R)$_2$, —OC(=O)N(R)$_2$, —C(O)N(OR)R, —C(NOR)R, —S(=O)$_3$R, —NRSO$_2$N(R)$_2$, —NRSO$_2$R, —N(OR)R, —C(=NH)—N (R)$_2$, —P(=O)$_2$R, —PO(R)$_2$, —OPO(R)$_2$, —(CH$_2$)$_{0-2}$NHC(=O)R, phenyl (Ph) optionally substituted with R, —O(Ph) optionally substituted with R, —(CH$_2$)$_{1-2}$(Ph), optionally substituted with R, —CH=CH(Ph), optionally substituted with R, C$_1$-C$_6$ alkyl, C$_1$-C$_6$ alkoxy, aryl, heteroaryl, cycloalkyl, heterocycloalkyl, halo-substituted C$_1$-C$_6$alkyl, halo-substituted C$_1$-C$_6$alkoxy, where each R is independently selected from H, C$_1$-C$_6$ alkyl, C$_2$-C$_6$ alkenyl, C$_2$-C$_6$ alkynyl, C$_1$-C$_6$ alkoxy, aryl, heteroaryl, C$_{3-8}$ cycloalkyl, C$_{3-8}$ heterocycloalkyl, halo-substituted C$_1$-C$_6$alkyl, halo-substituted C$_1$-C$_6$alkoxy; and two R groups on the same or on adjacent connected atoms can be taken together to form a 5-6 membered ring optionally containing an additional N, O or S as a ring member. Suitable substituents for alkyl, cycloalkyl, and heterocycloalkyl groups can further include =CHR, =O (oxo) and =N—R. Preferred substituents for an aryl or heteroaryl group are selected from F, Cl, Br, CN, —NR'$_2$, hydroxy, C$_1$-C$_4$ alkyl, C$_1$-C$_4$ haloalkyl, C$_1$-C$_4$ alkoxy, C$_1$-C$_4$ haloalkoxy, C$_1$-C$_4$alkoxy-C$_1$-C$_4$alkyl, —COOR', —CONR'$_2$, —SR', and —SO$_2$R', where each R' is H or C$_1$-C$_4$ alkyl. Preferred substituents for an alkyl, cycloalkyl or heterocycloalkyl group are selected from oxo (=O), F, Cl, Br, CN, —NR'$_2$, hydroxy, C$_1$-C$_4$ alkyl, C$_1$-C$_4$ haloalkyl, C$_1$-C$_4$ alkoxy, C$_1$-C$_4$ haloalkoxy, C$_1$-C$_4$alkoxy-C$_1$-C$_4$alkyl, —COOR', —CONR'$_2$, —SR', and —SO$_2$R', where each R' is H or C$_1$-C$_4$ alkyl.

The term "amino acid" refers to naturally occurring, synthetic, and unnatural amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, γ-carboxyglutamate, and O-phosphoserine. Amino acid analogs refer to compounds that have the same basic chemical structure as a naturally occurring amino acid, i.e., an α-carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. Amino acid mimetics refers to chemical compounds that have a structure that is different from the general chemical structure of an amino acid, but that functions in a manner similar to a naturally occurring amino acid.

The term "unnatural amino acid", as used herein, is intended to represent amino acid structures that cannot be generated biosynthetically in any organism using unmodified or modified genes from any organism, whether the same or different. In addition, it is understood that such "unnatural amino acids" require a modified tRNA and a modified tRNA synthetase (RS) for incorporation into a protein. These "selected" orthogonal tRNA/RS pair are specific for the unnatural amino acid and are generated by a selection process as developed by Schultz et al. (see, e.g., Liu et al., Annu. Rev. Biochem. 79:413-444, 2010) or a similar procedure. The term "unnatural amino acid" does not include the natural occurring 22$^{nd}$ proteinogenic amino acid pyrrolysine (Pyl) as well as its demethylated analog pyrroline-carboxy-lysine (Pcl), because incorporation of both residues into proteins is mediated by the unmodified, naturally occurring pyrrolysyl-tRNA/tRNA synthetase pair (see, e.g., Ou et al., Proc. Natl. Acad. Sci. USA. 108:10437-10442, 2011).

The term "antibody" as used herein refers to a polypeptide of the immunoglobulin family that is capable of binding a corresponding antigen non-covalently, reversibly, and in a specific manner. For example, a naturally occurring IgG antibody is a tetramer comprising at least two heavy (H) chains and two light (L) chains inter-connected by disulfide bonds. Each heavy chain is comprised of a heavy chain variable region (abbreviated herein as V$_H$) and a heavy chain constant region. The heavy chain constant region is comprised of three domains, CH1, CH2 and CH3. Each light chain is comprised of a light chain variable region (abbreviated herein as V$_L$) and a light chain constant region. The light chain constant region is comprised of one domain, C$_L$. The V$_H$ and V$_L$ regions can be further subdivided into regions of hypervariability, termed complementarity determining regions (CDR), interspersed with regions that are more conserved, termed framework regions (FR). Each V$_H$ and V$_L$ is composed of three CDRs and four FRs arranged from amino-terminus to carboxy-terminus in the following order: FR1, CDR1, FR2, CDR2, FR3, CDR3, and FR4. The variable regions of the heavy and light chains contain a binding domain that interacts with an antigen. The constant regions of the antibodies may mediate the binding of the immunoglobulin to host tissues or factors, including various cells of the immune system (e.g., effector cells) and the first component (Clq) of the classical complement system.

The term "antibody" includes, but is not limited to, monoclonal antibodies, human antibodies, humanized antibodies, camelid antibodies, chimeric antibodies, and anti-idiotypic (anti-Id) antibodies (including, e.g., anti-Id antibodies to antibodies of the invention). The antibodies can be of any isotype/class (e.g., IgG, IgE, IgM, IgD, IgA and IgY), or subclass (e.g., IgG1, IgG2, IgG3, IgG4, IgA1 and IgA2).

Both the light and heavy chains are divided into regions of structural and functional homology. The terms "constant" and "variable" are used functionally. In this regard, it will be appreciated that the variable domains of both the light (V$_L$) and heavy (V$_H$) chain portions determine antigen recognition and specificity. Conversely, the constant domains of the light chain (C$_L$) and the heavy chain (CH1, CH2 or CH3) confer important biological properties such as secretion, transplacental mobility, Fc receptor binding, complement binding, and the like. By convention, the numbering of the constant region domains increases as they become more distal from the antigen binding site or amino-terminus of the antibody. The N-terminus is a variable region and at the C-terminus is a constant region; the CH3 and C$_L$ domains actually comprise the carboxy-terminal domains of the heavy and light chain, respectively.

The term "antigen binding fragment", as used herein, refers to one or more portions of an antibody that retain the ability to specifically interact with (e.g., by binding, steric hindrance, stabilizing/destabilizing, spatial distribution) an epitope of an antigen. Examples of binding fragments include, but are not limited to, single-chain Fvs (scFv), disulfide-linked Fvs (sdFv), Fab fragments, F(ab) fragments, a monovalent fragment consisting of the V$_L$, V$_H$, C$_L$ and CH1 domains; a F(ab)$_2$ fragment, a bivalent fragment comprising two Fab fragments linked by a disulfide bridge at the hinge region; a Fd fragment consisting of the V$_H$ and CH1 domains; a Fv fragment consisting of the V$_L$ and V$_H$ domains of a single arm of an antibody; a dAb fragment (Ward et al., Nature 341:544-546, 1989), which consists of a V$_H$ domain; and an isolated complementarity determining region (CDR), or other epitope-binding fragments of an antibody.

Furthermore, although the two domains of the Fv fragment, V$_L$ and V$_H$, are coded for by separate genes, they can be joined, using recombinant methods, by a synthetic linker that enables them to be made as a single protein chain in which the V$_L$ and V$_H$ regions pair to form monovalent molecules (known as single chain Fv ("scFv"); see, e.g., Bird et al., Science 242:423-426, 1988; and Huston et al, Proc. Natl. Acad. Sci. 85:5879-5883, 1988). Such single chain antibodies are also intended to be encompassed within the term "antigen binding fragment." These antigen binding fragments are obtained using conventional techniques known to those of skill in the art, and the fragments are screened for utility in the same manner as are intact antibodies.

Antigen binding fragments can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can be grafted into scaffolds based on polypeptides such as fibronectin type III (Fn3)(see U.S. Pat. No. 6,703,199, which describes fibronectin polypeptide monobodies).

Antigen binding fragments can be incorporated into single chain molecules comprising a pair of tandem Fv segments ($V_H$-CH1-$V_H$-CH1) which, together with complementary light chain polypeptides, form a pair of antigen binding regions (Zapata et al., Protein Eng. 8:1057-1062, 1995; and U.S. Pat. No. 5,641,870).

The term "monoclonal antibody" or "monoclonal antibody composition" as used herein refers to polypeptides, including antibodies and antigen binding fragments that have substantially identical amino acid sequence or are derived from the same genetic source. This term also includes preparations of antibody molecules of single molecular composition. A monoclonal antibody composition displays a single binding specificity and affinity for a particular epitope.

The term "human antibody", as used herein, includes antibodies having variable regions in which both the framework and CDR regions are derived from sequences of human origin. Furthermore, if the antibody contains a constant region, the constant region also is derived from such human sequences, e.g., human germline sequences, or mutated versions of human germline sequences or antibody containing consensus framework sequences derived from human framework sequences analysis, for example, as described in Knappik et al., J. Mol. Biol. 296:57-86, 2000).

The human antibodies of the invention may include amino acid residues not encoded by human sequences (e.g., mutations introduced by random or site-specific mutagenesis in vitro or by somatic mutation in vivo, or a conservative substitution to promote stability or manufacturing).

The term "humanized" antibody, as used herein, refers to an antibody that retains the reactivity of a non-human antibody while being less immunogenic in humans. This can be achieved, for instance, by retaining the non-human CDR regions and replacing the remaining parts of the antibody with their human counterparts. See, e.g., Morrison et al., Proc. Natl. Acad. Sci. USA, 81:6851-6855 (1984); Morrison and Oi, Adv. Immunol., 44:65-92 (1988); Verhoeyen et al., Science, 239:1534-1536 (1988); Padlan, Molec. Immun., 28:489-498 (1991); Padlan, Molec. Immun., 31(3):169-217 (1994).

The term "recognize" as used herein refers to an antibody or antigen binding fragment thereof that finds and interacts (e.g., binds) with its epitope, whether that epitope is linear or conformational. The term "epitope" refers to a site on an antigen to which an antibody or antigen binding fragment of the invention specifically binds. Epitopes can be formed both from contiguous amino acids or noncontiguous amino acids juxtaposed by tertiary folding of a protein. Epitopes formed from contiguous amino acids are typically retained on exposure to denaturing solvents, whereas epitopes formed by tertiary folding are typically lost on treatment with denaturing solvents. An epitope typically includes at least 3, 4, 5, 6, 7, 8, 9, 10, 11, 12, 13, 14 or 15 amino acids in a unique spatial conformation. Methods of determining spatial conformation of epitopes include techniques in the art, for example, x-ray crystallography and 2-dimensional nuclear magnetic resonance (see, e.g., Epitope Mapping Protocols in Methods in Molecular Biology, Vol. 66, G. E. Morris, Ed. (1996)).

The term "affinity" as used herein refers to the strength of interaction between antibody and antigen at single antigenic sites. Within each antigenic site, the variable region of the antibody "arm" interacts through weak non-covalent forces with antigen at numerous sites; the more interactions, the stronger the affinity.

The term "isolated antibody" refers to an antibody that is substantially free of other antibodies having different antigenic specificities. An isolated antibody that specifically binds to one antigen may, however, have cross-reactivity to other antigens. Moreover, an isolated antibody may be substantially free of other cellular material and/or chemicals.

The term "conservatively modified variant" applies to both amino acid and nucleic acid sequences. With respect to particular nucleic acid sequences, conservatively modified variants refers to those nucleic acids which encode identical or essentially identical amino acid sequences, or where the nucleic acid does not encode an amino acid sequence, to essentially identical sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations," which are one species of conservatively modified variations. Every nucleic acid sequence herein which encodes a polypeptide also describes every possible silent variation of the nucleic acid. One of skill will recognize that each codon in a nucleic acid (except AUG, which is ordinarily the only codon for methionine, and TGG, which is ordinarily the only codon for tryptophan) can be modified to yield a functionally identical molecule. Accordingly, each silent variation of a nucleic acid that encodes a polypeptide is implicit in each described sequence.

For polypeptide sequences, "conservatively modified variants" include individual substitutions, deletions or additions to a polypeptide sequence which result in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the invention. The following eight groups contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M)(see, e.g., Creighton, Proteins (1984)). In some embodiments, the term "conservative sequence modifications" are used to refer to amino acid modifications that do not significantly affect or alter the binding characteristics of the antibody containing the amino acid sequence.

The term "optimized" as used herein refers to a nucleotide sequence has been altered to encode an amino acid sequence using codons that are preferred in the production cell or organism, generally a eukaryotic cell, for example, a yeast cell, a *Pichia* cell, a fungal cell, a *Trichoderma* cell, a Chinese Hamster Ovary cell (CHO) or a human cell. The optimized nucleotide sequence is engineered to retain completely or as much as possible the amino acid sequence originally encoded by the starting nucleotide sequence, which is also known as the "parental" sequence.

The terms "percent identical" or "percent identity," in the context of two or more nucleic acids or polypeptide sequences, refers to two or more sequences or subsequences that are the same. Two sequences are "substantially identical" if two sequences have a specified percentage of amino acid residues or nucleotides that are the same (i.e., 60% identity, optionally 65%, 70%, 75%, 80%, 85%, 90%, 95%, or 99% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or more preferably over a region that is 100 to 500 or 1000 or more nucleotides (or 20, 50, 200 or more amino acids) in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well known in the art. Optimal alignment of sequences for comparison can be conducted, e.g., by the local homology algorithm of Smith and Waterman, Adv. Appl. Math. 2:482c (1970), by the homology alignment algorithm of Needleman and Wunsch, J. Mol. Biol. 48:443 (1970), by the search for similarity method of Pearson and Lipman, Proc. Natl. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., Current Protocols in Molecular Biology, 2003).

Two examples of algorithms that are suitable for determining percent sequence identity and sequence similarity are the BLAST and BLAST 2.0 algorithms, which are described in Altschul et al., Nuc. Acids Res. 25:3389-3402, 1977; and Altschul et al., J. Mol. Biol. 215:403-410, 1990, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a word length (W) of 11, an expectation (E) or 10, M=5, N=−4 and a comparison of both strands. For amino acid sequences, the BLASTP program uses as defaults a word length of 3, and expectation (E) of 10, and the BLOSUM62 scoring matrix (see Henikoff and Henikoff, (1989) Proc. Natl. Acad. Sci. USA 89:10915) alignments (B) of 50, expectation (E) of 10, M=5, N=−4, and a comparison of both strands.

The BLAST algorithm also performs a statistical analysis of the similarity between two sequences (see, e.g., Karlin and Altschul, Proc. Natl. Acad. Sci. USA 90:5873-5787, 1993). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

The percent identity between two amino acid sequences can also be determined using the algorithm of E. Meyers and W. Miller, Comput. Appl. Biosci. 4:11-17, 1988) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch, J. Mol. Biol. 48:444-453, 1970) algorithm which has been incorporated into the GAP program in the GCG software package (available at www.gcg.com), using either a Blossom 62 matrix or a PAM250 matrix, and a gap weight of 16, 14, 12, 10, 8, 6, or 4 and a length weight of 1, 2, 3, 4, 5, or 6.

Other than percentage of sequence identity noted above, another indication that two nucleic acid sequences or polypeptides are substantially identical is that the polypeptide encoded by the first nucleic acid is immunologically cross reactive with the antibodies raised against the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules or their complements hybridize to each other under stringent conditions, as described below. Yet another indication that two nucleic acid sequences are substantially identical is that the same primers can be used to amplify the sequence.

The term "nucleic acid" is used herein interchangeably with the term "polynucleotide" and refers to deoxyribonucleotides or ribonucleotides and polymers thereof in either single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs).

Unless otherwise indicated, a particular nucleic acid sequence also implicitly encompasses conservatively modified variants thereof (e.g., degenerate codon substitutions) and complementary sequences, as well as the sequence explicitly indicated. Specifically, as detailed below, degenerate codon substitutions may be achieved by generating sequences in which the third position of one or more selected (or all) codons is substituted with mixed-base and/or deoxyinosine residues (Balzer et al., (1991) Nucleic Acid Res. 19:5081; Ohtsuka et al., (1985) J. Biol. Chem. 260: 2605-2608; and Rossolini et al, (1994) Mol. Cell. Probes 8:91-98).

The term "operably linked" in the context of nucleic acids refers to a functional relationship between two or more polynucleotide (e.g., DNA) segments. Typically, it refers to the functional relationship of a transcriptional regulatory sequence to a transcribed sequence. For example, a promoter or enhancer sequence is operably linked to a coding sequence if it stimulates or modulates the transcription of the coding sequence in an appropriate host cell or other expression system. Generally, promoter transcriptional regulatory sequences that are operably linked to a transcribed sequence are physically contiguous to the transcribed sequence, i.e., they are cis-acting. However, some transcriptional regulatory sequences, such as enhancers, need not be physically contiguous or located in close proximity to the coding sequences whose transcription they enhance.

The terms "polypeptide" and "protein" are used interchangeably herein to refer to a polymer of amino acid residues. The terms apply to amino acid polymers in which one or more amino acid residue is an artificial chemical mimetic of a corresponding naturally occurring amino acid, as well as to naturally occurring amino acid polymers and non-naturally occurring amino acid polymer. Unless otherwise indicated, a particular polypeptide sequence also implicitly encompasses conservatively modified variants thereof.

The term "immunoconjugate" or "antibody conjugate" as used herein refers to the linkage of an antibody or an antigen binding fragment thereof with another agent, such as a chemotherapeutic agent, a toxin, an immunotherapeutic agent, an imaging probe, a spectroscopic probe, and the like. The linkage can be covalent bonds, or non-covalent interactions such as through electrostatic forces. Various linkers, known in the art, can be employed in order to form the immunoconjugate. Additionally, the immunoconjugate can be provided in the form of a fusion protein that may be expressed from a polynucleotide encoding the immunoconjugate. As used herein, "fusion protein" refers to proteins created through the joining of two or more genes or gene fragments which originally coded for separate proteins (including peptides and polypeptides). Translation of the fusion gene results in a single protein with functional properties derived from each of the original proteins.

The term "subject" includes human and non-human animals. Non-human animals include all vertebrates, e.g., mammals and non-mammals, such as non-human primates, sheep, dog, cow, chickens, amphibians, and reptiles. Except when noted, the terms "patient" or "subject" are used herein interchangeably.

The term "cytotoxin", or "cytotoxic agent" as used herein, refer to any agent that is detrimental to the growth and proliferation of cells and may act to reduce, inhibit, or destroy a cell or malignancy.

The term "anti-cancer agent" as used herein refers to any agent that can be used to treat a cell proliferative disorder such as cancer, including but not limited to, cytotoxic agents, chemotherapeutic agents, radiotherapy and radiotherapeutic agents, targeted anti-cancer agents, and immunotherapeutic agents.

The term "terminal group (TG)" as used herein refers to a chemical moiety or a surface that is conjugated to the antibody or antigen binding fragment of the invention. For example, a terminal group can be a drug moiety selected from an anti-cancer agent, an anti-inflammatory agent, an antifungal agent, an antibacterial agent, an anti-parasitic agent, an anti-viral agent, an anesthetic agent. In certain embodiments a drug moiety is selected from a V-ATPase inhibitor, a HSP90 inhibitor, an IAP inhibitor, an mTor inhibitor, a microtubule stabilizer, a microtubule destabilizers, an auristatin, a dolastatin, a maytansinoid, a MetAP (methionine aminopeptidase), an inhibitor of nuclear export of proteins CRM1, a DPPIV inhibitor, an inhibitors of phosphoryl transfer reactions in mitochondria, a protein synthesis inhibitor, a kinase inhibitor, a CDK2 inhibitor, a CDK9 inhibitor, a proteasome inhibitor, an EG5 inhibitor, an HDAC inhibitor, a DNA damaging agent, a DNA alkylating agent, a DNA intercalator, a DNA minor groove binder and a DHFR inhibitor. Suitable examples include auristatins such as MMAE and MMAF; calicheamycins such as gamma-calicheamycin; and maytansinoids such as DM1 and DM4. Methods for attaching each of these to a linker compatible with the antibodies and method of the invention are known in the art. See, e.g., Singh et a, Therapeutic Antibodies: Methods and Protocols, vol. 525, 445-457 (2009). In addition a terminal group can be a biophysical probe, a fluorophore, a spin label, an infrared probe an affinity probe, a chelator, a spectroscopic probe, a radioactive probe, a lipid molecule, a polyethylene glycol, a polymer, a spin label, DNA, RNA, a protein, a peptide, a surface, an antibody, an antibody fragment, a nanoparticle, a quantum dot, a liposome, a PLGA particle, or a polysaccharide. In embodiments wherein the terminal group is a surface, such solid supports include, but are not limited to, glass, cellulose, polyacrylamide, nylon, polystyrene, polyvinyl chloride or polypropylene.

"Tumor" refers to neoplastic cell growth and proliferation, whether malignant or benign, and all pre-cancerous and cancerous cells and tissues.

The term "anti-tumor activity" means a reduction in the rate of tumor cell proliferation, viability, or metastatic activity. A possible way of showing anti-tumor activity is to show a decline in growth rate of abnormal cells that arises during therapy or tumor size stability or reduction. Such activity can be assessed using accepted in vitro or in vivo tumor models, including but not limited to xenograft models, allograft models, MMTV models, and other known models known in the art to investigate anti-tumor activity.

The term "malignancy" refers to a non-benign tumor or a cancer. As used herein, the term "cancer" includes a malignancy characterized by deregulated or uncontrolled cell growth. Exemplary cancers include: carcinomas, sarcomas, leukemias, and lymphomas.

The term "cancer" includes primary malignant tumors (e.g., those whose cells have not migrated to sites in the subject's body other than the site of the original tumor) and secondary malignant tumors (e.g., those arising from metastasis, the migration of tumor cells to secondary sites that are different from the site of the original tumor).

The term "insertion" in the context of inserting a peptide tag into an antibody means the incorporation of a peptide tag between two specific residues of an antibody. The total number of residues of the antibody is increased by the number of inserted tag residues.

The term "grafting" in the context of incorporating a peptide tag into an antibody refers to the incorporation of a peptide tag into an antibody by mutagenesis. For instance, a short stretch of amino acid residues within a non-CDR loop is substituted by a peptide sequence. In this case, the total number of residues of the antibody remains unchanged. In some embodiments, the term "grafting" also encompasses a combination of substitution and insertion of peptide tag residues. For example, one part of the peptide tag is incorporated by substitution of structural loop residues, while the remaining part is inserted between specific residues of the non-CDR loop. The total number of residues of the IgG antibody is increased by a number that is smaller than the number of tag residues.

BRIEF DESCRIPTION OF THE FIGURES

Figure 2A:
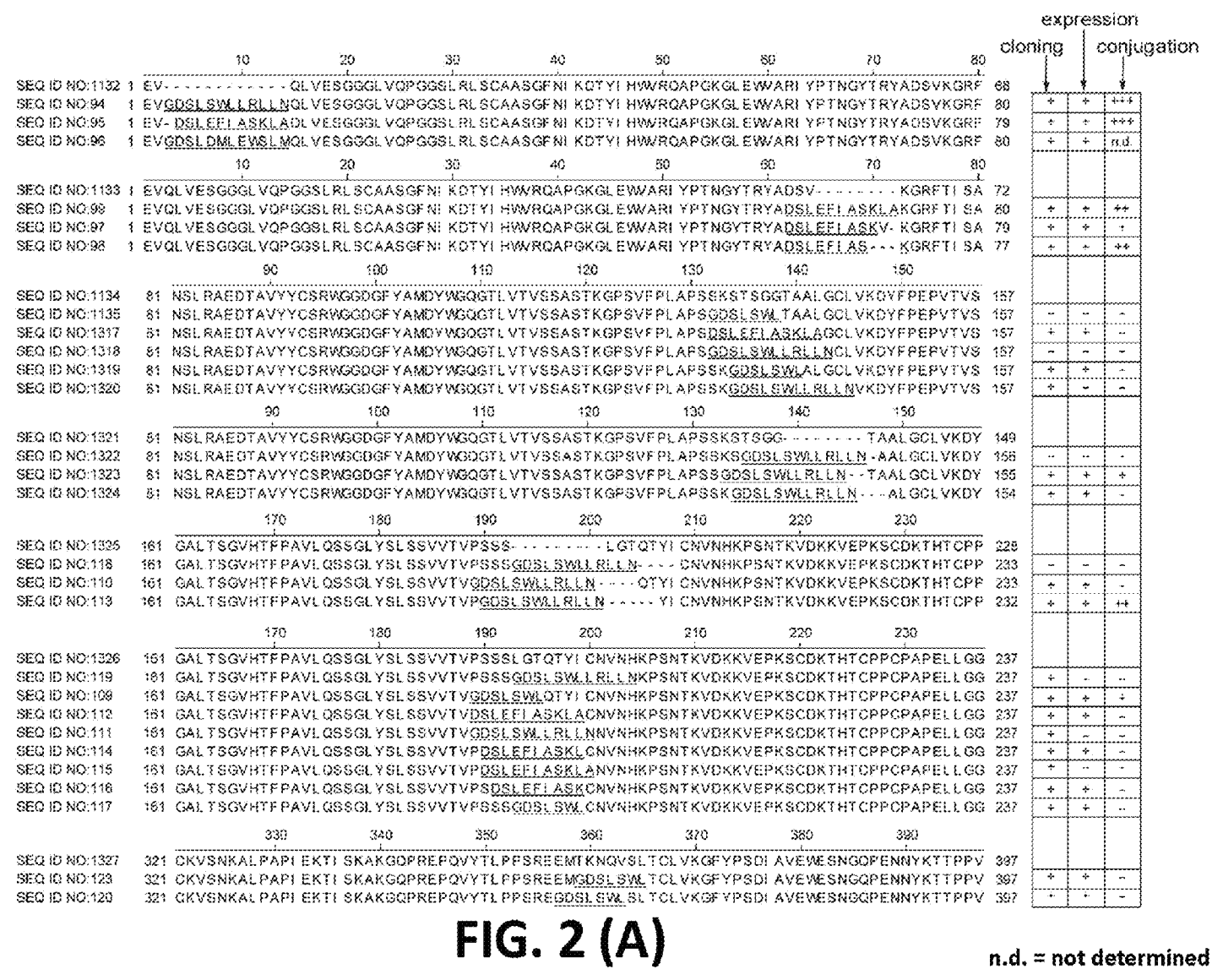
Figure 2B:
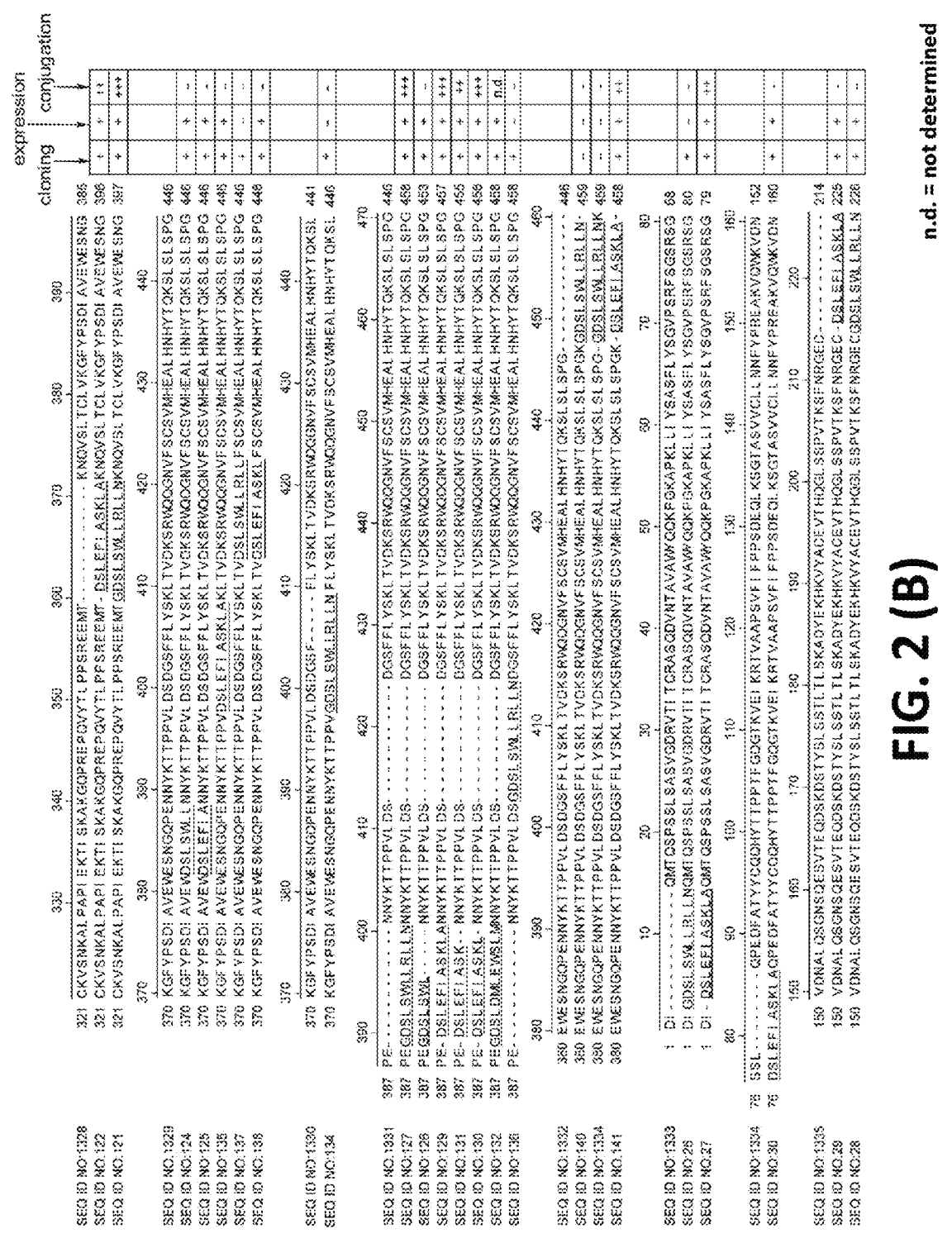

FIG. 2. Design of IgG1 constructs which contain peptide tags for site-specific antibody labeling via post-translational 4'-phosphopantetheinylation. (A) IgG1 constructs contain peptide tags (underlined) in the $V_H$, CH1, and CH3 domains. (B) IgG1 constructs contain peptide tags (underlined) in the CH3, $V_L$, and $C_L$ domains. Designed constructs that were successfully cloned are marked by a plus (+) sign in the left column. Unsuccessful cloning is indicated by a minus (−) sign. Successfully cloned constructs are grouped as non-expressors (−) and expressors (+) (middle column). Expressors which do not show any detectable Sfp-catalyzed product formation in the presence of CoA-MC-MMAF substrate (acetyl-CoA substrate was used for SEQ ID NOs: 28, 105, 118, 120, 123, and 126) are marked with a minus (−) sign in the right column. Very low but detectable formation of the respective MC-MMAF ADC is indicated with a plus (+) symbol. Significantly more efficient but non-quantitative MC-MMAF ADC formation is indicated by a double plus (++) sign. Quantitatively generated MC-MMAF ADCs with two terminal groups (TGs) are classified with a triple plus (+++) rating (according to HPLC analysis). The residue positions disclosed in FIG. 2(A) and FIG. 2(B) are the indicated 'residues of' the corresponding SEQ ID NO according to the Eu numbering system for each sequence.

FIG. 2(A) discloses SEQ ID NO: 1132, residues 1-80 of SEQ ID NO: 94, residues 1-79 of SEQ ID NO: 95, residues 1-80 of SEQ ID NO: 96, SEQ ID NO: 1133, residues 1-80 of SEQ ID NO: 99, residues 1-79 of SEQ ID NO: 97, residues 1-77 of SEQ ID NO: 98, SEQ ID NOS 1134-1135 and 1317-1325, residues 43-115 of SEQ ID NO: 118, residues 43-115 of SEQ ID NO: 110, residues 43-114 of SEQ ID NO: 113, SEQ ID NO: 1326, residues 43-119 of SEQ ID NO: 119, residues 43-119 of SEQ ID NO: 109, residues 43-119 of SEQ ID NO: 112, residues 43-119 of SEQ ID NO: 111, residues 43-119 of SEQ ID NO: 114, residues 43-119 of SEQ ID NO: 115, residues 43-119 of SEQ ID NO: 116, residues 43-119 of SEQ ID NO: 117, SEQ ID NO: 1327, residues 203-279 of SEQ ID NO: 123, and residues 203-279 of SEQ ID NO: 120, all respectively, in order of appearance.

FIG. 2(B) discloses SEQ ID NO: 1328, residues 203-278 of SEQ ID NO: 122, residues 203-279 of SEQ ID NO: 121, SEQ ID NO: 1329, residues 252-328 of SEQ ID NO: 124, residues 252-328 of SEQ ID NO: 125, residues 252-328 of SEQ ID NO: 135, residues 252-328 of SEQ ID NO: 137, residues 252-328 of SEQ ID NO: 138, SEQ ID NO: 1330, residues 252-328 of SEQ ID NO: 134, SEQ ID NO: 1331, residues 269-340 of SEQ ID NO: 127, residues 269-335 of SEQ ID NO: 126, residues 269-339 of SEQ ID NO: 129, residues 269-337 of SEQ ID NO: 131, residues 269-338 of SEQ ID NO: 130, residues 269-340 of SEQ ID NO: 132, residues 269-340 of SEQ ID NO: 136, SEQ ID NO: 1332, residues 262-341 of SEQ ID NO: 140, SEQ ID NO: 1336, residues 262-340 of SEQ ID NO: 141, SEQ ID NO: 1333, residues 1-80 of SEQ ID NO: 26, residues 1-79 of SEQ ID NO: 27, SEQ ID NO: 1334, residues 76-160 of SEQ ID NO: 30, SEQ ID NO: 1335, residues 42-117 of SEQ ID NO: 29, and residues 42-118 of SEQ ID NO: 28, all respectively, in order of appearance.

FIG. 3. (A) Sequence of CH1 domain, CH2 domain, CH3 domain, and hinge region of the Ig gamma 1 heavy chain (SEQ ID NO: 93). (B) Sequence of $C_L$ domain of the Ig kappa light chain (SEQ ID NO: 24). Underlined amino acids are structural loops. Amino acid positions are numbered according to the EU numbering system as described in Edelman et al., Proc. Natl. Acad. USA 63:78-85 (1969). X'$_1$, X'$_2$, X'$_3$, X'$_4$, X'$_5$, and X'$_6$ indicate residues that are present at allotypic positions within the IgG1 subclass and the kappa isotype (according to Jefferis et al., MAbs. 1:332-338 (2009)).

FIG. 4. (A) Sequence alignment of CH1 domain, CH2 domain, CH3 domain, and hinge region of the four human Ig gamma subclasses with Trastuzumab (SEQ ID NOS 1109-1113, respectively, in order of appearance). (B) Sequence alignment of $C_L$ domain with Trastuzumab (SEQ ID NOS 1114-1115, respectively, in order of appearance). Underlined residues belong to structural loops (see also FIG. 3). Boxed residues indicate allotypic positions according to Jefferis et al., MAbs. 1:332-338 (2009). For simplicity, only the allotypic positions within the IgG1 subclass and the kappa isotype are shown. Protein sequences of the human Ig gamma subclasses and the human kappa isotype are derived from the UniProt database (entry numbers P01857, P01859, P01860, P01861, and P01834).

FIG. 9. HPLC characterization of fluorophore attachment to IgGs. (A) HPLC trace confirming the near quantitative formation of the antibody-fluorophore conjugate anti-hHER2-HC-P189G-S190D-S191-ppan-maleimidoethyl-amido-TMR-S192L-L193S-G194W-T195L (SEQ ID NO: 1127). The extensive overlap between the HPLC traces monitored at 280 and 555 nm indicates near quantitative fluorophore conjugation. (B) HPLC trace confirming the near quantitative formation of the antibody-fluorophore conjugate anti-hHER2-HC-T359-GDS-ppan-maleimidoethyl-amido-TMR-LSWLLRLLN-K360 (SEQ ID NO: 1128). The extensive overlap between the HPLC traces monitored at 280 and 555 nm indicates near quantitative fluorophore conjugation.

FIG. 14. Optimization of enzymatic conjugation reaction as a function of CoA-MC-MMAF substrate concentration at pH 8.0. (A) The HPLC traces represent three conjugation reactions with 2.5 µM anti-hHER2-HC-E388-GDSLSWLL-RLLN-N389 (SEQ ID NO: 127) that contained 2.5 µM (top trace), 7.5 µM (middle trace), or 25 µM (bottom trace) of CoA-MC-MMAF. The peak at a retention time of 4.9 min corresponds to unlabeled antibody (DAR=0), the peak at 5.3 min to mono-labeled antibody (DAR=1), and the peak at 5.7 min to bi-labeled antibody (DAR=2). (B) The bar graph representation shows the amount of generated ADC with a DAR of 2 as a function of CoA-MC-MMAF substrate concentration. The titration series was performed at an Sfp enzyme concentration of either 0.25 µM (black bars) or 1.0 µM (white bars).

DETAILED DESCRIPTION

Figure 1:
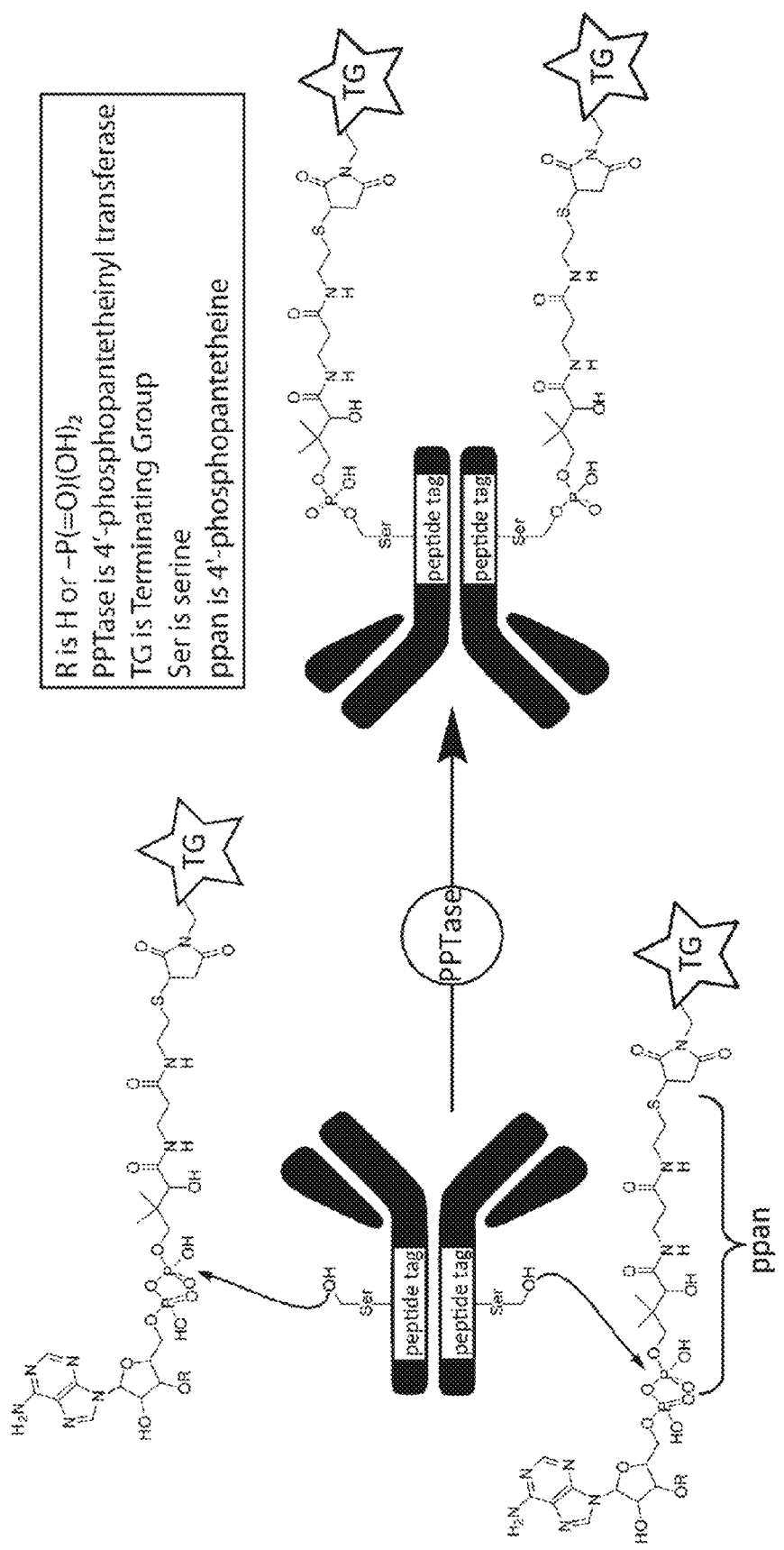
FIG. 1. Schematic description of 4'-phosphopantetheinyl transferase (PPTase)-mediated generation of ADCs.

The present invention provides methods of site-specific labeling of antibodies, using proteins having 4'-phosphopantetheinyl transferase activity ("PPTases") that catalyze post-translational modification of peptide sequences ("peptide tags") incorporated into one or more specific sites of an antibody of interest. Enzymatic labeling under ambient reaction conditions enables quantitative and irreversible covalent modification of a specific serine residue within the peptide tags incorporated into the antibody, and thus creates desirable antibody conjugates.

Given the broad substrate tolerance of PPTases, site-specific antibody labeling according to the present invention can be achieved with a variety of chemically accessible labeling reagents, such as anti-cancer agents, fluorophores, peptides, sugars, detergents, polyethylene glycols, immune potentiators, radio-imaging probes, prodrugs, and other molecules. Furthermore, PPTases can be used to immobilize peptide-tagged antibodies on solid support, such as polystyrene nanoparticles and gold surfaces (see, e.g., Wong et al., Org. Biomol. Chem. 8: 782-787, 2010; Wong et al., Nanoscale 4:659-666, 2012, for methodology of immobilization of functional enzymes).

Accordingly, the present invention provides methods of preparation of homogeneous immunoconjugates with a defined drug-to-antibody ratio for use in cancer therapy, and immunoconjugates prepared thereby, as well as pharmaceutical compositions comprising these immunoconjugates. The methods of the instant invention can be used in combination with other conjugation methods known in the art.

1. Antibody Engineering

Site-Specific Labeling

A "structural loop" or "non-CDR-loop" according to the present invention is to be understood in the following manner: antibodies are made of domains with immunoglobulin folds. In essence, anti-parallel beta sheets are connected by loops to form a compressed antiparallel beta barrel. In the variable region, some of the loops of the domains contribute essentially to the specificity of the antibody, i.e., the binding to an antigen. These loops are called "CDR-loops." All other loops of antibody domains are rather contributing to the structure of the molecule and/or the effector function. These loops are defined herein as "structural loops" or "non-CDR-loops."

Figure 4:
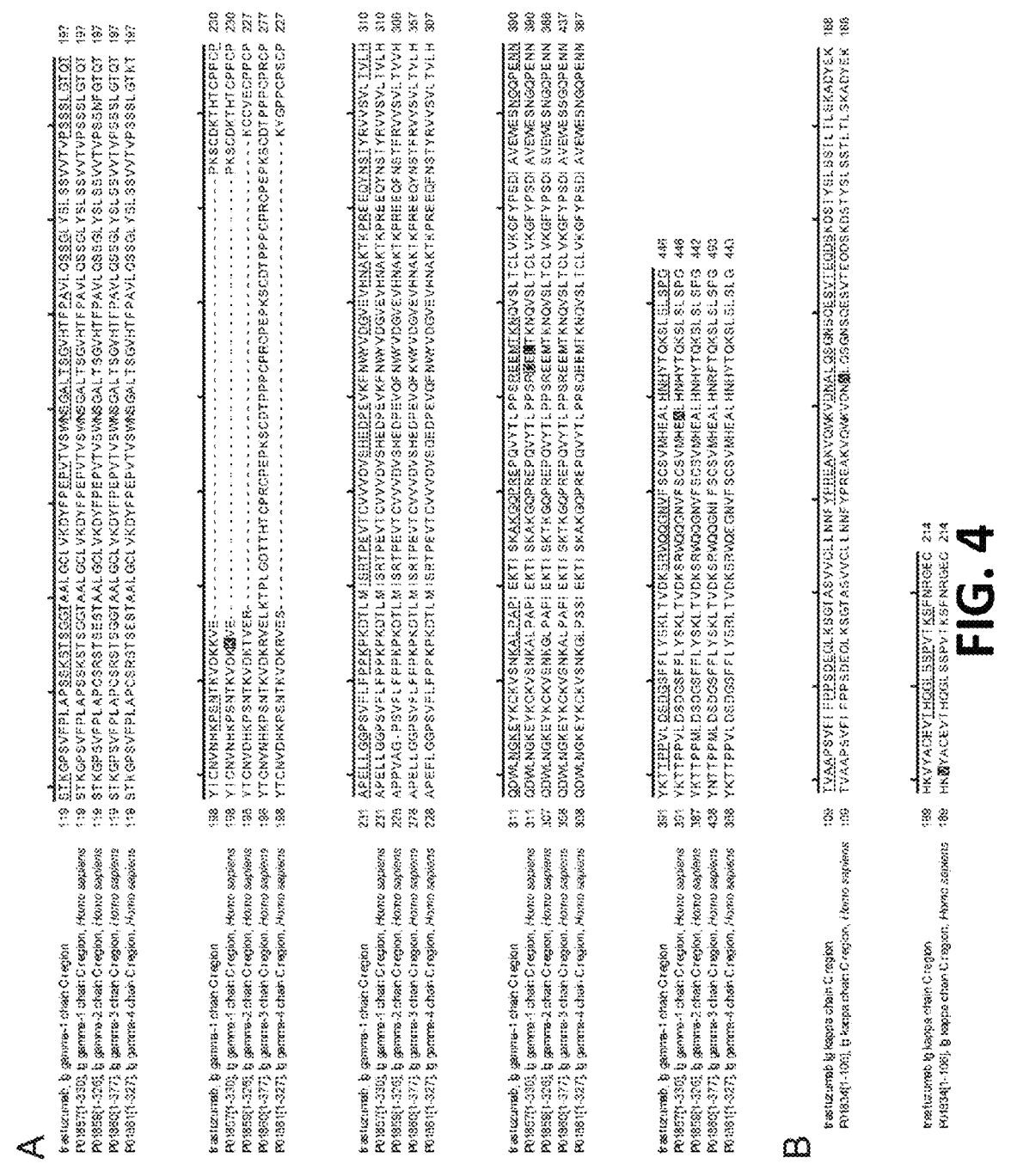

The antibodies (e.g., a parent or native antibody, optionally containing one or more non-naturally occurring amino acids) of the present invention are numbered according to the EU numbering system as set forth in Edelman et al., Proc. Natl. Acad. USA 63:78-85 (1969). Human IgG1 constant region is used as a representative throughout the application. However, the invention is not limited to human IgG1; corresponding amino acid positions can be readily deduced by sequence alignment. For example, FIG. 3(A) shows IgG1 heavy chain constant region where the structural loops are underlined, these underlined structural loops can be readily identified for IgG2, IgG3, and IgG4 as shown in the sequence alignment of FIG. 4(A). FIG. 3(B) shows the light chain constant region where the structural loops are underlined. For the light chain constant region, IgG1, IgG2, IgG3 and IgG4 are the same. Table 1 below lists the amino acid positions in the structural loop of IgG1, IgG2, IgG3 and IgG4, respectively.

TABLE 1

Identified Structural Loop Positions (IgG1 according to EU numbering)

| | IgG1 | IgG2 | IgG3 | IgG4 |
|---|---|---|---|---|
| Heavy Chain | 119(S)120(T)121(K) 131(S)132(S)133(K) 134(S)135(T)136(S) 137(G)138(G)139(T) (SEQ ID NO: 1018) | 119(S)120(T)121(K) 131(C)132(S)133(R) 134(S)135(T)136(S) 137(E)138(S)139(T) (SEQ ID NO: 1019) | 119(S)120(T)121(K) 131(C)132(S)133(R) 134(S)135(T)136(S) 137(G)138(G)139(T) (SEQ ID NO: 1020) | 119(S)120(T)121(K) 131(C)132(S)133(R) 134(S)135(T)136(S) 137(E)138(S)139(T) (SEQ ID NO: 1019) |
| | 152(E)153(P)154(V) 159(N)160(S)161(G) 162(A)163(L)164(T) 165(S)166(G) (SEQ ID NO: 1021) | 152(E)153(P)154(V) 159(N)160(S)161(G) 162(A)163(L)164(T) 165(S)166(G) (SEQ ID NO: 1021) | 152(E)153(P)154(V) 159(N)160(S)161(G) 162(A)163(L)164(T) 165(S)166(G) (SEQ ID NO: 1021) | 152(E)153(P)154(V) 159(N)160(S)161(G) 162(A)163(L)164(T) 165(S)166(G) (SEQ ID NO: 1021) |
| | 171(P)172(A) 176(S)177(S)178(G) 189(P)190(S)191(S) 192(S)193(L)194(G) 195(T)196(Q)197(T) (SEQ ID NO: 1022) | 171(P)172(A) 176(S)177(S)178(G) 189(P)190(S)191(S) 192(N)193(F)194(G) 195(T)196(Q)197(T) (SEQ ID NO: 1023) | 171(P)172(A) 176(S)177(S)178(G) 189(P)190(S)191(S) 192(S)193(L)194(G) 195(T)196(Q)197(T) (SEQ ID NO: 1022) | 171(P)172(A) 176(S)177(S)178(G) 189(P)190(S)191(S) 192(S)193(L)194(G) 195(T)196(K)197(T) (SEQ ID NO: 1024) |
| | 205(K)206(P)207(S) 208(N) (SEQ ID NO: 1025) | 205(K)206(P)207(S) 208(N) (SEQ ID NO: 1025) | 205(K)206(P)207(S) 208(N) (SEQ ID NO: 1025) | 205(K)206(P)207(S) 208(N) (SEQ ID NO: 1025) |
| | 230(P)231(A)232(P) 233(E)234(L)235(L) 236(G)236(G) (SEQ ID NO: 1026) | 227(P)228(A)229(P) 230(P)231(V)232(A) 233(G) (SEQ ID NO: 1027) | 277(P)278(A)279(P)280(E)281(L)282(L)283(G)284(G) (SEQ ID NO: 1026) | 227(P)228(A)229(P) 230(E)231(F)232(L) 233(G)234(G) (SEQ ID NO: 1028) |
| | 244(P)245(P)246(K) 253(I)254(S)255(R) 256(T)257(P)258(E) (SEQ ID NO: 1029) | 240(P)241(P)242(K) 249(I)250(S)251(R) 252(T)253(P)254(E) (SEQ ID NO: 1029) | 291(P)292(P)293(K) 300(I)301(S)302(R) 303(T)304(P)305(E) (SEQ ID NO: 1029) | 241(P)242(P)243(K) 250(I)251(S)252(R) 253(T)254(P)255(E) (SEQ ID NO: 1029) |
| | 267(S)268(H)269(E) 270(D)271(P)272(E) (SEQ ID NO: 1030) | 263(S)264(H)265(E) 266(D)267(P)268(E) (SEQ ID NO: 1030) | 314(S)315(H)316(E) 317(D)318(P)319(E) (SEQ ID NO: 1030) | 264(S)265(Q)266(E) 267(D)268(P)269(E) (SEQ ID NO: 1031) |
| | 280(D)281(G) 285(H)286(N)287(A) 291(P)292(R) 295(Q)296(Y)297(N) 298(S)299(T) (SEQ ID NO: 1032) | 276(D)277(G) 281(H)282(N)283(A) 287(P)288(R) 291(Q)292(F)293(N) 294(S)295(T) (SEQ ID NO: 1033) | 327(D)328(G) 332(H)333(N)334(A) 338(P)339(R) 342(Q)343(Y)344(N) 345(S)346(T) (SEQ ID NO: 1032) | 277(D)278(G) 282(H)283(N)284(A) 288(P)289(R) 292(Q)293(F)294(N) 295(S)296(T) (SEQ ID NO: 1033) |
| | 307(T)308(V)309(L) 310(H)311(Q) (SEQ ID NO: 1034) | 303(T)304(V)305(V) 306(H)307(Q) (SEQ ID NO: 1035) | 354(T)355(V)356(L) 357(H)358(Q) (SEQ ID NO: 1034) | 304(T)305(V)306(L) 307(H)308(Q) (SEQ ID NO: 1034) |
| | 315(N)316(G)317(K) 318(E) (SEQ ID NO: 1036) | 311(N)312(G)313(K) 314(E) (SEQ ID NO: 1036) | 362(N)363(G)364(K)365(E) (SEQ ID NO: 1036) | 312(N)313(G)314(K) 315(E) (SEQ ID NO: 1036) |
| | 326(K)327(A)328(L) 329(P)330(A)331(P) (SEQ ID NO: 1037) | 322(K)323(G)324(L) 325(P)326(A)327(P) (SEQ ID NO: 1038) | 373(K)374(A)375(L) 376(P)377(A)378(P) (SEQ ID NO: 1037) | 323(K)324(G)325(L) 326(P)327(S)328(S) (SEQ ID NO: 1039) |
| | 339(A)340(K)341(G) 342(Q)343(P)344(R) 345(E) (SEQ ID NO: 1040) | 335(T)336(K)337(G) 338(Q)339(P)340(R) 341(E) (SEQ ID NO: 1041) | 386(T)387(K)388(G) 389(Q)390(P)391(R) 392(E) (SEQ ID NO: 1041) | 336(A)337(K)338(G) 339(Q)340(P)341(R) 342(E) (SEQ ID NO: 1040) |
| | 355(R)356(D/E) 357(E)358(L/M) 359(T)360(K)361(N) (SEQ ID NO: 1042) | 351(R)352(E)353(E) 354(M)355(T)356(K) 357(N) (SEQ ID NO: 1043) | 402(R)403(E)404(E) 405(M)406(T)407(K) 408(N) (SEQ ID NO: 1043) | 352(Q)353(E)354(E) 355(M)356(T)357(K) 358(N) (SEQ ID NO: 1044) |
| | 384(N)385(G) 388(E)389(N)390(N) 394(T)395(P)396(P) 399(D)400(S)401(D) 402(G) (SEQ ID NO: 1045) | 380(N)381(G) 384(E)385(N)386(N) 390(T)391(P)392(P) 395(D)396(S)397(D) 398(G) (SEQ ID NO: 1045) | 431(S)432(G) 435(E)436(N)437(N) 441(T)442(P)443(P) 446(D)447(S)448(D) 449(G) (SEQ ID NO: 1045) | 381(N)382(G) 385(E)386(N)387(N) 391(T)392(P)393(P) 396(D)397(S)398(D) 399(G) (SEQ ID NO: 1045) |
| | 415(S)416(R) 417(W)418(Q) 419(Q)420(G) 421(N)422(V) (SEQ ID NO: 1046) | 411(S)412(R)413(W) 414(Q)415(Q)416(G) 417(N)418(V) (SEQ ID NO: 1046) | 462(S)463(R)464(W) 465(Q)466(Q)467(G) 468(N)469(I) (SEQ ID NO: 1047) | 412(S)413(R)414(W) 415(Q)416(E)417(G) 418(N)419(V) (SEQ ID NO: 1048) |
| | 433(H)434(N)435(H) 442(S)443(L)444(S) 445(P)446(G) (SEQ ID NO: 1049) | 429(H)430(N)431(H) 438(S)439(L)440(S) 441(P)442(G) (SEQ ID NO: 1049) | 480(H)481(N)482(R) 489(S)490(L)491(S) 492(P)493(G) (SEQ ID NO: 1049) | 430(H)431(N)432(H) 439(S)440(L)441(S) 442(L)443(G) (SEQ ID NO: 1050) |
| Light Chain | 109(T)110(V)111(A) 112(A) (SEQ ID NO: 1051) | 109(T)110(V)111(A) 112(A) (SEQ ID NO: 1051) | 109(T)110(V)111(A) 112(A) (SEQ ID NO: 1051) | 109(T)110(V)111(A) 112(A) (SEQ ID NO: 1051) |
| | 119(P)120(P)121(S) 122(D)123(E) (SEQ ID NO: 1052) | 119(P)120(P)121(S) 122(D)123(E) (SEQ ID NO: 1052) | 119(P)120(P)121(S) 122(D)123(E) (SEQ ID NO: 1052) | 119(P)120(P)121(S) 122(D)123(E) (SEQ ID NO: 1052) |
| | 140(Y)141(P)142(R) 143(E)144(A) (SEQ | 140(Y)141(P)142(R) 143(E)144(A) (SEQ ID | 140(Y)141(P)142(R) 143(E)144(A) (SEQ ID | 140(Y)141(P)142(R) 143(E)144(A) (SEQ ID |

TABLE 1-continued

Identified Structural Loop Positions (IgG1 according to EU numbering)

| IgG1 | IgG2 | IgG3 | IgG4 |
|---|---|---|---|
| ID NO: 1053) | NO: 1053) | NO: 1053) | NO: 1053) |
| 151(D)152(N)153(A) | 151(D)152(N)153(A) | 151(D)152(N)153(A) | 151(D)152(N)153(A) |
| 154(L)155(Q)156(S) | 154(L)155(Q)156(S) | 154(L)155(Q)156(S) | 154(L)155(Q)156(S) |
| (SEQ ID NO: 1054) | (SEQ ID NO: 1054) | (SEQ ID NO: 1054) | (SEQ ID NO: 1054) |
| 161(E)162(S)163(V) | 161(E)162(S)163(V) | 161(E)162(S)163(V) | 161(E)162(S)163(V) |
| 164(T)165(E)166(Q) | 164(T)165(E)166(Q) | 164(T)165(E)166(Q) | 164(T)165(E)166(Q) |
| 167(D)168(S) (SEQ ID NO: 1055) | 167(D)168(S) (SEQ ID NO: 1055) | 167(D)168(S) (SEQ ID NO: 1055) | 167(D)168(S) (SEQ ID NO: 1055) |
| 197(T)198(H)199(Q) | 197(T)198(H)199(Q) | 197(T)198(H)199(Q) | 197(T)198(H)199(Q) |
| 200(G)201(L)202(S) | 200(G)201(L)202(S) | 200(G)201(L)202(S) | 200(G)201(L)202(S) |
| 203(S)204(P) (SEQ ID NO: 1056) | 203(S)204(P) (SEQ ID NO: 1056) | 203(S)204(P) (SEQ ID NO: 1056) | 203(S)204(P) (SEQ ID NO: 1056) |
| 207(K)208(S) | 207(K)208(S) | 207(K)208(S) | 207(K)208(S) |

FIG. 3 as well as SEQ ID NOs 24 and 93 represent the sequences of the Ig kappa light chain constant region and the Ig gamma-1 heavy chain constant region, respectively. $X'_1$, $X'_2$, $X'_3$, $X'_4$, $X'_5$, and $X'_6$ in SEQ ID NOs: 24 and 93 indicate residues that are present at allotypic positions within the IgG1 subclass and the kappa isotype (according to Jefferis et al., MAbs. 1:332-338 (2009)). $X'_1$ can be Arg or Lys, $X'_2$ can be Asp or Glu, $X'_3$ can be Leu or Met, $X'_4$ can be Ala or Gly, $X'_5$ can be Val or Ala, and $X'_6$ can be Leu or Val.

Because of the high sequence homology of constant regions of IgG1, IgG2, IgG3 and IgG4 antibodies, findings of the invention are not limited to any specific antibodies. In addition, the findings of the invention are not limited to using PPTases. The positions in the antibody structural loops identified herein can also be used for incorporating other peptide tags, which are substrates for other enzymatic conjugation approaches such as the enzyme biotin protein ligase (BPL), transglutaminases, and formylglycine forming enzymes.

In one aspect, the present invention provides immunoconjugates comprising a modified antibody or an antigen binding fragment thereof, and a terminal group, wherein said modified antibody or antigen binding fragment thereof comprises a peptide tag that by itself is a substrate of a 4'-phosphopantetheinyl transferase, and wherein said peptide tag is located within a structural loop, or C- or N-terminus of the modified antibody or antigen binding fragment thereof. The present invention also provides modified antibodies or antigen binding fragments thereof comprising a peptide tag that is a substrate of a 4'-phosphopantetheinyl transferase, and wherein said peptide tag is located within a structural loop, or C- or N-terminus of the antibody or antigen binding fragment thereof. In a specific embodiment, said peptide tag is one or more peptides selected from those described in Table 2. In one aspect, the peptide tag is inserted between two amino acids of a structural loop of said antibody or antigen binding fragment thereof. In another aspect, the peptide tag is grafted into a structural loop, C- or N-terminus of said antibody or antigen binding fragment thereof, wherein the peptide tag replaces one or more amino acids of the parent antibody or antigen binding fragment thereof. In one aspect, the structural loop refers to a structural loop located at the CH1, CH2, CH3, or $C_L$ region of said antibody or antigen binding fragment thereof. The modified antibody heavy chain and/or light chain (or antigen binding fragment thereof) may contain 1, 2, 3, 4, 5, 6, 7, 8, or more protein tags in its structural loops. In one aspect, the modified antibodies or antigen binding fragments contain 2, 4, 6, 8, or more protein tags in its structural loops. In another aspect, said 4'-phosphopantetheinyl transferase is Sfp, AcpS, T. maritima PPTase, human PPTase, or a mutant form thereof that retains the 4'-phosphopantetheinyl transferase activity. In one aspect, said 4'-phosphopantetheinyl transferase originates from Homo sapiens, Bacillus subtilis, Escherichia coli, Thermotoga maritima, Clostridium thermocellum, as well as any other mammalian, bacterial or fungal genome. In another aspect, said 4'-phosphopantetheinyl transferase is a homologous protein to Sfp, AcpS, T maritima PPTase, human PPTase, or a mutant thereof. In one embodiment, said 4'-phosphopantetheinyl transferase is from a thermophilic organism. In some embodiments, the parental antibody (antibody without incorporating the peptide tag) is an IgG, IgM, IgE, or IgA antibody. In some embodiments, the parental antibody is an IgG1 antibody. In some other embodiments, the parental antibody is an IgG2, IgG3, or IgG4 antibody.

"A substrate of 4'-phosphopantetheinyl transferase" as used herein means the structure being described can serve as an acceptor for a 4'-phosphopantetheine (ppan) or modified ppan group as illustrated in Scheme 1a herein when contacted with 4'-phosphopantetheinyl transferase and CoA or a CoA analog having a terminal group attached to it.

In one aspect, the present invention provides immunoconjugates comprising a modified antibody or an antigen binding fragment thereof, and a terminal group, wherein said modified antibody or antigen binding fragment thereof comprises a CH1, CH2, CH3, and/or $C_L$ region, and wherein said CH1, CH2, CH3, and/or $C_L$ region further comprises a peptide tag that by itself is a substrate of a 4'-phosphopantetheinyl transferase. The present invention also provides modified antibodies or antigen binding fragments thereof comprising a CH1, CH2, CH3, and/or $C_L$ region, and wherein said CH1, CH2, CH3, and/or $C_L$ region further comprises a peptide tag that is a substrate of a 4'-phosphopantetheinyl transferase. In some embodiments, said peptide tag is one or more peptides selected from those described in Table 2. In some embodiments, the peptide tag is inserted between two amino acids of a structural loop of said antibody or antigen binding fragment thereof. In some embodiments, the peptide tag is grafted into a structural loop of said antibody or antigen binding fragment thereof. The modified antibody heavy chain and/or light chain (or antigen binding fragment thereof) may contain 1, 2, 3, 4, 5, 6, 7, 8, or more protein tags in its structural loops. In some embodiments, the modified antibodies or antigen binding fragments contain 2, 4, 6, 8, or more protein tags in its structural loops. In some embodiments, said 4'-phosphopantetheinyl transferase is Sfp, AcpS, T. maritima PPTase, human PPTase, or a mutant form thereof that retains the 4'-phosphopantetheinyl transferase activity. In some embodiments, said 4'-phosphopantetheinyl transferase originates from *Homo sapiens, Bacillus subtilis, Escherichia coli, Thermotoga maritima, Clostridium thermocellum*, as well as any other mammalian, bacterial or fungal genome. In some embodiments, said 4'-phosphopantetheinyl transferase is a homologous protein to Sfp, AcpS, *T maritima* PPTase, or a mutant thereof. In one embodiment, said 4'-phosphopantetheinyl transferase is from a thermophilic organism. In some embodiments, the parental antibody is an IgG, IgM, IgE, or IgA antibody. In a specific embodiment, the parental antibody is an IgG1 antibody. In some embodiments, the parental antibody is an IgG2, IgG3, or IgG4 antibody.

As used herein, "retains" activity means the enzyme being described maintains at least about 10% of the activity of the reference material, which is the *B. subtilis* Sfp 4'-phosphopantetheinyl transferase (see, e.g., Quadri et al., *Biochemistry* 37: 1585-1595 (1998)). For example, a different 4'-phosphopantetheinyl transferase or a mutant form of the enzyme retains at least about 10% of the 4'-phosphopantetheinyl transferase activity compared to Sfp under identical reaction conditions, i.e., using the same CoA substrate, the same peptide-tagged antibody, identical buffer conditions, identical substrate and enzyme concentrations, the same temperature, and the same reaction duration.

In one aspect, the present invention provides immunoconjugates comprising a modified antibody or an antigen binding fragment thereof, and a terminal group, wherein said modified antibody or antigen binding fragment thereof comprises a peptide tag that by itself is a substrate of a 4'-phosphopantetheinyl transferase, and wherein said peptide tag is inserted between positions 2 and 3 of the $V_H$ domain, positions 63 and 64 of the $V_H$ domain, positions 64 and 65 of the $V_H$ domain, positions 138 and 139 of the CH1 domain, positions 197 and 198 of the CH1 domain, positions 359 and 360 of the CH3 domain, positions 388 and 389 of the CH3 domain, the C-terminus of the CH3 domain (after Lys447), and/or positions 2 and 3 of the $V_L$ domain of a parental antibody or antigen binding fragment thereof. In another aspect, the present invention provides immunoconjugates comprising a modified antibody or antigen binding fragment thereof, and a terminal group, wherein said modified antibody or antigen binding fragment thereof comprises a peptide tag that by itself is a substrate of a 4'-phosphopantetheinyl transferase, and wherein the peptide tag is inserted between amino acid residues 2 and 3 of the VH or VL domain, or between amino acid residue 110 and 111 of the light chain, or between 119 and 120, or between 120 and 121, or between 135 and 136, or between 136 and 137, or between 138 and 139, or between 164 and 165, or between 165 and 166, or between 194 and 195 of the CH1 domain, or between 388 and 389, or between 445 and 446, or between 446 and 447 of the CH3 domain of a parental antibody or antigen binding fragment thereof. In some embodiments, the peptide tag is inserted between amino acid residue 110 and 111 of the light chain, or between 119 and 120, or between 120 and 121, or between 135 and 136, or between 136 and 137, or between 138 and 139, or between 165 and 166 of the CH1 domain, or between 388 and 389 of the CH3 domain of a parental antibody or antigen binding fragment thereof, In one aspect, the invention provides immunoconjugates comprising a modified antibody or an antigen binding fragment thereof, and a terminal group, wherein said modified antibody or antigen binding fragment thereof comprises SEQ ID NO: 103, SEQ ID NO: 109, SEQ ID NO:113, SEQ ID NO:121, SEQ ID NO:122, SEQ ID NO:127, SEQ ID NO:129, SEQ ID NO:130, SEQ ID NO:131, and/or SEQ ID NO:141. In another aspect, the invention provides immunoconjugates comprising a modified antibody or an antigen binding fragment thereof, and a terminal group, wherein said modified antibody or antigen binding fragment comprises comprises SEQ ID NO:26, SEQ ID NO:27, SEQ ID NO:32, SEQ ID NO:63, SEQ ID NO:94, SEQ ID NO:95, SEQ ID NO:96, SEQ ID NO:126, SEQ ID NO:127, SEQ ID NO:129, SEQ ID NO:130, SEQ ID NO:131, SEQ ID NO:132, SEQ ID NO:139, SEQ ID NO:149, SEQ ID NO:151, SEQ ID NO:152, SEQ ID NO:157, SEQ ID NO:158, SEQ ID NO:160, SEQ ID NO:168, SEQ ID NO:169, SEQ ID NO:178, SEQ ID NO:248, SEQ ID NO:250, SEQ ID NO:251, SEQ ID NO:256, SEQ ID NO:257, SEQ ID NO:259, SEQ ID NO:267, SEQ ID NO:268, SEQ ID NO:277, SEQ ID NO:348, SEQ ID NO:349, SEQ ID NO:356, SEQ ID NO:358, SEQ ID NO:359, SEQ ID NO:364, SEQ ID NO:365, SEQ ID NO:367, SEQ ID NO:373, SEQ ID NO:374, SEQ ID NO:380, SEQ ID NO:384, SEQ ID NO:386, SEQ ID NO:387, or SEQ ID NO:388. In some embodiments, the modified antibody or antigen binding fragment comprises SEQ ID NO:32, SEQ ID NO:63, SEQ ID NO:127, SEQ ID NO:129, SEQ ID NO:132, SEQ ID NO:151, SEQ ID NO:152, SEQ ID NO:157, SEQ ID NO:158, SEQ ID NO:160, SEQ ID NO:169, SEQ ID NO:250, SEQ ID NO:251, SEQ ID NO:256, SEQ ID NO:257, SEQ ID NO:259, SEQ ID NO:268, SEQ ID NO:358, SEQ ID NO:359, SEQ ID NO:364, SEQ ID NO:365, SEQ ID NO:367, SEQ ID NO:374, or SEQ ID NO:384.

With respect to the immunoconjugates described herein, in one aspect, said peptide tag is one or more peptides selected from those described in Table 2. The modified antibody heavy chain and/or light chain (or antigen binding fragment thereof) may contain 1, 2, 3, 4, 5, 6, 7, 8, or more protein tags in its structural loops. In one embodiment, the modified antibodies or antigen binding fragments contain 2, 4, 6, 8, or more protein tags in its structural loops. In another embodiment, said 4'-phosphopantetheinyl transferase is Sfp, AcpS, *T. maritima* PPTase, human PPTase, or a mutant form thereof that retains the 4'-phosphopantetheinyl transferase activity. In one embodiment, said 4'-phosphopantetheinyl transferase originates from *Homo sapiens, Bacillus subtilis, Escherichia coli, Thermotoga maritime, Clostridium thermocellum*, as well as any other mammalian, bacterial or fungal genome. In a specific embodiment, said 4'-phosphopantetheinyl transferase is Sfp and the peptide tag is selected from GDSLSWLLRLLN (SEQ ID NO:1), GDSLSWL (SEQ ID NO:2), DSLEFIASKLA (SEQ ID NO:9), GDSLDMLEWSLM (SEQ ID NO:10), DSLEFIASKL (SEQ ID NO:18), and DSLEFIASK (SEQ ID NO:19). In one embodiment, the parental antibody is an IgG, IgM, IgE, or IgA antibody. In a specific embodiment, the parental antibody is an IgG1 antibody. In another specific embodiment, the parental antibody is an IgG2, IgG3, or IgG4 antibody.

In another aspect, the present invention provides immunoconjugates comprising a modified antibody or an antigen binding fragment thereof, and a terminal group, wherein said modified antibody or antigen binding fragment thereof comprises a peptide tag that by itself is a substrate of a 4'-phosphopantetheinyl transferase, and wherein said peptide tag is grafted into a structural loop, or C- or N-terminus of the antibody or antigen binding fragment thereof. In a specific embodiment, said peptide tag is grafted at amino acid positions from 62 to 64 of the $V_H$ domain (mutations at amino acids 62 and 63, and insertion of the rest of the peptide tag between amino acids 63 and 64), at amino acid positions from 62 to 65 of the $V_H$ domain (mutations at amino acids 62-64, and insertion of the rest of the peptide tag between amino acids 64 and 65); at amino acid positions from 133 to 139 of the CH1 domain (mutations of amino acids 133-138, and insertion of the rest of the peptide tag between amino acids 138-139), amino acid positions from 189 to 195 of the CH1 domain, and/or amino acid positions from 190 to 198 of the CH1 domain (mutations from amino acids 190-197, and insertion of the rest of the peptide tag between 197 and 198) of a parental antibody or antigen binding fragment thereof. In one embodiment, said peptide tag is one or more peptides selected from those described in Table 2. The modified antibody heavy chain and/or light chain (or antigen binding fragment thereof) may contain 1, 2, 3, 4, 5, 6, 7, 8, or more protein tags in its structural loops. In one embodiment, the modified antibodies or antigen binding fragments contain 2, 4, 6, 8, or more protein tags in its structural loops. In another embodiment, said 4'-phosphopantetheinyl transferase is Sfp, AcpS, *T. maritima* PPTase, human PPTase, or a mutant form thereof that retains the 4'-phosphopantetheinyl transferase activity. In one embodiment, said 4'-phosphopantetheinyl transferase originates from *Homo sapiens, Bacillus subtilis, Escherichia coli, Thermotoga maritima, Clostridium thermocellum*, as well as any other mammalian, bacterial or fungal genome. In a specific embodiment, said 4'-phosphopantetheinyl transferase is Sfp and the peptide tag is selected from GDSLSWLLRLLN (SEQ ID NO:1), GDSLSWL (SEQ ID NO:2), DSLEFIASKLA (SEQ ID NO:9), GDSLDMLEWSLM (SEQ ID NO:10), DSLEFIASKL (SEQ ID NO:18), and DSLEFIASK (SEQ ID NO:19). In one embodiment, the parental antibody is an IgG, IgM, IgE, or IgA antibody. In a specific embodiment, the parental antibody is an IgG1 antibody. In another specific embodiment, the parental antibody is an IgG2, IgG3, or IgG4 antibody.

In another aspect, the present invention provides modified antibodies or antigen binding fragments thereof comprising a peptide tag that is a substrate of a 4'-phosphopantetheinyl transferase, and wherein said peptide tag is inserted between positions 2 and 3 of the $V_H$ domain, positions 63 and 64 of the $V_H$ domain, positions 64 and 65 of the $V_H$ domain, positions 138 and 139 of the CH1 domain, positions 197 and 198 of the CH1 domain, positions 359 and 360 of the CH3 domain, positions 388 and 389 of the CH3 domain, the C-terminus of the CH3 domain (after Lys447), and/or positions 2 and 3 of the $V_L$ domain of a parental antibody or antigen binding fragment thereof. In another aspect, the peptide tag is inserted between amino acid residues 2 and 3 of the VH or VL domain, or between amino acid residue 110 and 111 of the light chain, or between 119 and 120, or between 120 and 121, or between 135 and 136, or between 136 and 137, or between 138 and 139, or between 164 and 165, or between 165 and 166, or between 194 and 195 of the CH1 domain, or between 388 and 389, or between 445 and 446, or between 446 and 447 of the CH3 domain of a parental antibody or antigen binding fragment thereof. In some embodiments, the peptide tag is inserted between amino acid residue 110 and 111 of the light chain, or between 119 and 120, or between 120 and 121, or between 135 and 136, or between 136 and 137, or between 138 and 139, or between 165 and 166 of the CH1 domain, or between 388 and 389 of the CH3 domain of a parental antibody or antigen binding fragment thereof.

In another aspect, the present invention provides a modified antibody or antigen binding fragment thereof comprising SEQ ID NO: 103, SEQ ID NO: 109, SEQ ID NO:113, SEQ ID NO:121, SEQ ID NO:122, SEQ ID NO:127, SEQ ID NO:129, SEQ ID NO:130, SEQ ID NO:131, and/or SEQ ID NO:141. In another aspect, the present invention provides a modified antibody or antigen binding fragment thereof comprising SEQ ID NO:26, SEQ ID NO:27, SEQ ID NO:32, SEQ ID NO:63, SEQ ID NO:94, SEQ ID NO:95, SEQ ID NO:96, SEQ ID NO:126, SEQ ID NO:127, SEQ ID NO:129, SEQ ID NO:130, SEQ ID NO:131, SEQ ID NO:132, SEQ ID NO:139, SEQ ID NO:149, SEQ ID NO:151, SEQ ID NO:152, SEQ ID NO:157, SEQ ID NO:158, SEQ ID NO:160, SEQ ID NO:168, SEQ ID NO:169, SEQ ID NO:178, SEQ ID NO:248, SEQ ID NO:250, SEQ ID NO:251, SEQ ID NO:256, SEQ ID NO:257, SEQ ID NO:259, SEQ ID NO:267, SEQ ID NO:268, SEQ ID NO:277, SEQ ID NO:348, SEQ ID NO:349, SEQ ID NO:356, SEQ ID NO:358, SEQ ID NO:359, SEQ ID NO:364, SEQ ID NO:365, SEQ ID NO:367, SEQ ID NO:373, SEQ ID NO:374, SEQ ID NO:380, SEQ ID NO:384, SEQ ID NO:386, SEQ ID NO:387, or SEQ ID NO:388. In some embodiments, the present invention provides a modified antibody or antigen binding fragment thereof comprising SEQ ID NO:32, SEQ ID NO:63, SEQ ID NO:127, SEQ ID NO:129, SEQ ID NO:132, SEQ ID NO:151, SEQ ID NO:152, SEQ ID NO:157, SEQ ID NO:158, SEQ ID NO:160, SEQ ID NO:169, SEQ ID NO:250, SEQ ID NO:251, SEQ ID NO:256, SEQ ID NO:257, SEQ ID NO:259, SEQ ID NO:268, SEQ ID NO:358, SEQ ID NO:359, SEQ ID NO:364, SEQ ID NO:365, SEQ ID NO:367, SEQ ID NO:374, or SEQ ID NO:384.

In one aspect, said peptide tag is one or more peptides selected from those described in Table 2. The antibody heavy chain and/or light chain (or antigen binding fragment thereof) may contain 1, 2, 3, 4, 5, 6, 7, 8, or more protein tags in its structural loops. In some embodiments, the antibodies or antigen binding fragments contain 2, 4, 6, 8, or more protein tags in its structural loops. In some embodiments, said 4'-phosphopantetheinyl transferase is Sfp, AcpS, *T. maritima* PPTase, human PPTase, or a mutant form thereof that retains the 4'-phosphopantetheinyl transferase activity. In some embodiments, said 4'-phosphopantetheinyl transferase originates from *Homo sapiens, Bacillus subtilis, Escherichia coli, Thermotoga maritima, Clostridium thermocellum*, as well as any other mammalian, bacterial or fungal genome. In a specific embodiment, said 4'-phosphopantetheinyl transferase is Sfp and the peptide tag is selected from GDSLSWLLRLLN (SEQ ID NO:1), GDSLSWL (SEQ ID NO:2), DSLEFIASKLA (SEQ ID NO:9), GDSLDMLEWSLM (SEQ ID NO:10), DSLEFIASKL (SEQ ID NO:18), and DSLEFIASK (SEQ ID NO:19). In some embodiments, the parental antibody is an IgG, IgM, IgE, or IgA antibody. In a specific embodiment, the parental antibody is an IgG1 antibody. In some embodiments, the parental antibody is an IgG2, IgG3, or IgG4 antibody.

In another aspect, the present invention provides modified antibodies or antigen binding fragments thereof comprising a peptide tag that is a substrate of a 4'-phosphopantetheinyl transferase, and wherein said peptide tag is grafted into a structural loop, or C- or N-terminus of the antibody or antigen binding fragment thereof. In some embodiments, said peptide tag is grafted at amino acid positions from 62 to 64 of the $V_H$ domain (mutations at amino acids 62 and 63, and insertion of the rest of the peptide tag between amino acids 63 and 64), at amino acid positions from 62 to 65 of the $V_H$ domain (mutations at amino acids 62-64, and insertion of the rest of the peptide tag between amino acids 64 and 65); at amino acid positions from 133 to 139 of the CH1 domain (mutations of amino acids 133-138, and insertion of the rest of the peptide tag between amino acids 138-139), amino acid positions from 189 to 195 of the CH1 domain, and/or amino acid positions from 190 to 198 of the CH1 domain (mutations from amino acids 190-197, and insertion of the rest of the peptide tag between 197 and 198) of a parental antibody or antigen binding fragment thereof. In one embodiment, said peptide tag is one or more peptides selected from those described in Table 2. The modified antibody heavy chain and/or light chain (or antigen binding fragment thereof) may contain 1, 2, 3, 4, 5, 6, 7, 8, or more protein tags in its structural loops. In one embodiment, the modified antibodies or antigen binding fragments contain 2, 4, 6, 8, or more protein tags in its structural loops. In another embodiment, said 4'-phosphopantetheinyl transferase is Sfp, AcpS, T. maritima PPTase, human PPTase, or a mutant form thereof that retains the 4'-phosphopantetheinyl transferase activity. In one embodiment, said 4'-phosphopantetheinyl transferase originates from Homo sapiens, Bacillus subtilis, Escherichia coli, Thermotoga maritime, Clostridium thermocellum, as well as any other mammalian, bacterial or fungal genome. In some embodiments, said 4'-phosphopantetheinyl transferase is Sfp and the peptide tag is selected from GDSLSWLLRLLN (SEQ ID NO:1), GDSLSWL (SEQ ID NO:2), DSLEFIASKLA (SEQ ID NO:9), GDSLD-MLEWSLM (SEQ ID NO:10), DSLEFIASKL (SEQ ID NO:18), and DSLEFIASK (SEQ ID NO:19). In one embodiment, the parental antibody is an IgG, IgM, IgE, or IgA antibody. In a specific embodiment, the parental antibody is an IgG1 antibody. In some embodiments, the parental antibody is an IgG2, IgG3, or IgG4 antibody.

In certain aspects, the modified antibodies provided herein are engineered to contain one or more orthogonal conjugation sites. Such orthogonal conjugation sites include, but are not limited to, a substrate of Sfp 4'-phosphopantetheinyl transferase, a substrate of AcpS 4'-phosphopantetheinyl transferase, T. maritima 4'-phosphopantetheinyl transferase, human 4'-phosphopantetheinyl transferase, a lysine, a cysteine, a tyrosine, a histidine, an unnatural amino acid, pyrrolysine and pyrroline-carboxy-lysine. The orthogonal conjugation sites may also be peptide sequences that can be enzymatically or chemically modified, e.g., a tetracysteine tag, a LPXTG-sortase peptide (SEQ ID NO: 1057) (X is any amino acid), a biotin acceptor peptide, a CXPXR-aldehyde tag (SEQ ID NO: 1058) (X is any amino acid), or a His tag. In certain embodiments, such engineered antibodies are labeled using the methods of the invention in combination with other conjugation methods known in the art including, but not limited to, chemoselective conjugation through cysteine, lysine, histidine, tyrosine, formyl-glycine, pyrrolysine, pyrroline-carboxylysine and unnatural amino acids.

In certain aspects, the enzymes Sfp and AcpS are used for orthogonal site-specific labeling of the same or two different labels onto an antibody engineered to contain an S-series peptide (for example, S1, S2, S3, S4, S5, S6 and S7) and an A-series peptide (for example, A1, A-1, A-2, A-3, A-4 and A-6) located in the VH, VL, CH1, CH2, CH3, or $C_L$ region of the antibody (see also Table 2).

In other aspects, the enzymes Sfp and AcpS are used for orthogonal site-specific labeling of two different labels onto an antibody engineered to contain an ybbR-series peptide (for example, ybbR11, ybbR12 and ybbR13) and an A-series peptide (for example, A1, A-1, A-2, A-3, A-4 and A-6) located in the CH1, CH2, CH3, or $C_L$ region of the antibody.

In other aspects, the enzymes Sfp or AcpS are used for orthogonal site-specific labeling onto an antibody engineered to contain an ybbR-series peptide (for example, ybbR11, ybbR12 and ybbR13) and an A-series peptide (for example, A1, A-1, A-2, A-3, A-4 and A-6) located in the VH, VL, CH1, CH2, CH3, or $C_L$ region of the antibody in combination with other conjugation methods. Such methods include but are not limited to conjugation to lysine, cysteine, tyrosine, histidine, formyl glycine, unnatural amino acids, pyrrolysine and/or pyrroline-carboxy-lysine. Such methods can be used to attached the same or different labels than used for the enzymatic conjugation through Sfp or AcpS.

Proteins Having 4'-Phosphopantetheinyl Transferase Activity and Peptide Substrates As used herein, the terms "4'-phosphopantetheinyl transferase" (PPTases) and "protein having 4'-phosphopantetheinyl transferase activity" are used interchangeably and refer to any protein or a fragment thereof, which is capable of transferring a ppan group from a donor molecule, such as coenzyme A (CoA) or an analog thereof, to a substrate, such as a peptide tag or an acyl carrier protein.

PPTases are enzymes which catalyze post-translational modification of carrier proteins associated with fatty acid synthases (FASs), polyketide synthases (PKSs) and nonribosomal peptide synthetases (NRPSs). These carrier proteins are commonly referred to as ACP, acyl carrier proteins (FASs and PKSs) or to as PCP, peptidyl carrier proteins (NRPSs). ACPs and PCPs consist of about 80 amino acids and are usually integrated as domains in FAS, PKS, or NRPS multienzyme complexes. In some instances, ACPs and PCPs are also found as free-standing autonomously folded proteins. The ACP is essential for fatty acid and polyketide biosynthesis, because it carries the corresponding metabolic intermediates via covalent attachment to its flexible ppan prosthetic group. The PCP carries out the analogous function in nonribosomal peptide synthesis by transporting peptide intermediates between active sites in NRPS multienzyme complexes. PPTases have been classified into three groups, based on sequence and structural similarity and substrate specificity. Members of the first group of PPTases, for example, AcpS of Escherichia coli, are about 120 amino acid residues long, function as homotrimers, and have fairly narrow substrate specificities limited to, for example, to the acetyl carrier proteins (ACPs) of type II FAS and PKS systems. Members of the second group, exemplified by Sfp of Bacillus subtilis or the human PPTase, function as monomers, and have been reported to have broad substrate specificities that include carrier proteins associated with NRPs, FASs and PKSs. (see, e.g., Suo et al., Proc. Natl. Acad. Sci. USA 3 98:99-104, 2001; Quadri et al., Biochem., 37:1585-95, 1998; Liu et al., Arch. Microbiol, 183:37-44, 2005; Joshi et al., J. Biol. Chem., 278:33142-33149, 2003). The third group includes PPTases that are attached covalently to the type I FASs, such as those associated with the yeast cytosolic FAS. (see, e.g., Fichtlscherer et al., Eur. J. Biochem., 267:2666-71, 2000).

According to the present invention, PPTases include naturally occurring proteins having 4'-phosphopantetheinyl transferase activity, including but not limited to, AcpS from E. coli (type I PPTase) and Sfp from B. subtilis (type II PPTase), integrated PPTase domains (type III PPTase) associated with fatty acid synthases (FAS) from S. cerevisiae, S. pombe, C. albacans, E. nidulans, and P. patulum, EntD from E. coli, S. flexneri, S. typhimurium and S. austin, Psf-1 from B. pumilus, Gsp from B. brevis, Heti from Anabaena sp., Lys5 from S. cerevisiae, Lpa-14 from B. subtilis and 0195 from E. coli, PPTase (NP_228501) of T. maritima MSB8, PPTase (NP_056238) of Homo sapiens, and homologs and mutants thereof. PPTases of the present invention also include proteins having 4'-phosphopantetheinyl transferase activity from species other than the ones described above, as well as those artificially or recombinantly produced proteins, which are capable of 4'-phosphopantetheinylating a peptide moiety described herein.

Sfp and AcpS represent two classes of 4'-phosphopantetheinyl transferases that show differences both in their substrate specificity for the carrier protein domains and in their structures (Flugal et al., J. Biol. Chem., 275:959-968, 2000; Lambalot et al., Chem. Biol., 3:923-936, 1996). The Sfp class of pseudodimeric PPTases are about 230 residues in size and the crystal structure of Sfp suggests it has a twofold symmetry with the N- and the C-terminal halves of the molecule adopting similar folds, with the active site of the enzyme at the interface (Hodneland et a, Proc. Natl. Acad. Sci. USA, 99:5048-5052, 2002; Koglin et Science, 312:273-276, 2006). In contrast, AcpS is about 120 residues in length, about half the size of Sfp, and the crystal structures of AcpS show that the enzyme assembles into trimers and the ACP and CoA binding sites are formed at the interface between each monomer (Reuter et al., Embo. J., 18:6823-6831, 1999; Chirgadze et a, Embo. J., 19:5281-5287, 2000). It has been reported that Sfp exhibits a much broader substrate specificity than AcpS in that Sfp can modify both PCP and ACP domains from nonribosomal peptides synthetases, polyketide synthases, and fatty acid synthases, while AcpS modifies only ACP (Flugel et J. Biol. Chem., 275:959-968, 2000; Parris et at, Structure, 8:883-895, 2000; Mofid et al., J. Biol. Chem., 277:17023-17031, 2002).

ACP and PCP substrates of both kinds of PPTases adopt similar folds as four-helix bundle proteins with the serine residue to be modified by the ppan prosthetic group at the top of the second alpha-helix, which has been shown to play an important role for interacting with Sfp and AcpS (Hodneland et al., Proc. Natl. Acad. Sci. USA, 99:5048-5052, 2002; Chirgadze et al., Embo. J., 19:5281-5287, 2000; Quadri et al., Biochem., 37:1585-1595, 1998; $L_1$ et al., Biochem., 42:4648-4657, 2003). Although there is not an obvious consensus sequence difference between PCPs and ACPs, the most significant difference between the two is the electrostatic surface potential of the carrier proteins, with a neutral protein surface for PCPs and a negatively charged acidic surface for ACP domains in FAS and PKS systems (Parris et al., Structure, 8:883-895, 2000).

Groups of short peptides have been identified as efficient substrates for PPTases. For example, ybbR13 is an 11 amino acid residue peptide, which is a substrate of Sfp (J. Yin et al., Proc. Natl. Acad. Sci. USA, 102:15815-15820, 2005; Z. Zhou et al., ACS Chem. Biol., 2:337-346, 2007; Z. Zhou et a, J. Am. Chem. Soc., 130: 9925-9930, 2008). The ybbR13 peptide (DSLEFIASKLA (SEQ ID NO: 9)) was isolated from a phage displayed library of the B. subtilis genome (J. Yin et al., Proc. Natl. Acad. Sci. USA, 102:15815-15820, 2005). A part of the sequence of the ybbR13 peptide is derived from a B. subtilis open reading frame, called ybbR, and it includes the (H/D)S(L/I) tri-peptide sequence at the N-terminus, which is conserved in known substrates of PPTases such as ACPs, PCPs, and aryl carrier proteins (ArCPs). The ybbR peptide does not include the amino acid sequence, DxFFxxLGG (SEQ ID NO: 1059) at its N-terminus, which is found to be conserved in PCPs. Modifications and variants of the ybbR13 peptide have been described which can be used as substrates in 4'-phosphopantetheinylation reactions for site specific labeling (J. Yin et al., Proc. Natl. Acad. Sci. USA, 102:15815-15820, 2005). Additional peptide substrates for PPTases are the S series of peptides and the A series of peptides, designated as "S" or "A" based on their reactivity with Sfp or AcpS, respectively (Z. Zhou et al. ACS Chem. Biol., 2:337-346, 2007 and Z. Zhou et al. J. Am. Chem. Soc., 130:9925-9930, 2008). Exemplary S series of peptides include, but are not limited to, S6, which is an efficient substrate for Sfp, and exemplary A series of peptides include, but are not limited to, A1, which is an efficient substrate for AcpS. Both S6 and A1 peptides are 12 amino acid residues in length.

Examples of peptide substrates are listed in Table 2 below. According to the present invention, these short peptide tags can be used for the site-specific labeling of target proteins (including antibodies) in reactions catalyzed by PPTases. Additionally, a pairing of peptide tags and respective PPTases described herein, e.g., ybbR13/Sfp or S6/Sfp and A1/AcpS, can also be used for orthogonal site-specific labeling of one (or multiple) target proteins, e.g., in cell lysates or on the surface of live cells.

TABLE 2

PPTase peptide substrate examples.

| Sequence | SEQ ID NO: | Name |
|---|---|---|
| GD<u>S</u>LSWLLRLLN | 1 | S6 |
| GD<u>S</u>LSWL | 2 | S6 truncate |
| GD<u>S</u>LSWLVRCLN | 3 | S1 |
| GD<u>S</u>LSWLLRCLN | 4 | S2 |
| GD<u>S</u>LSWLLRLLN | 5 | S3 |
| GD<u>S</u>LSWLLRSLN | 6 | S7 |
| GSQDVLD<u>S</u>LEFIASKLA | 7 | Ybbr11 |
| VLD<u>S</u>LEFIASKLA | 8 | Ybbr12 |
| D<u>S</u>LEFIASKLA | 9 | Ybbr13 |
| GD<u>S</u>LDMLEWSLM | 10 | A1 |
| GD<u>S</u>LDMLEWSL | 11 | A-1 |
| GD<u>S</u>LDMLEWS | 12 | A-2 |
| GD<u>S</u>LDMLEW | 13 | A-3 |
| D<u>S</u>LDMLEW | 14 | A-4 |
| GD<u>S</u>LDM | 15 | A-6 |
| LD<u>S</u>VRMMALAAR | 16 | E0 |
| LD<u>S</u>LDMLEWSLR | 17 | E2 |
| D<u>S</u>LEFIASKL | 18 | ybbR truncate 1 |
| D<u>S</u>LEFIASK | 19 | ybbR truncate 2 |
| DVLD<u>S</u>LEFI | 20 | ybbR8 |
| VLD<u>S</u>LEFIAS | 21 | ybbR14 |

The modified serine residue is underlined.

Accordingly, the present invention provides engineered antibodies which contain one or more of the peptide tags listed in Table 2, and methods of labeling such antibodies, e.g., conjugating with a cytotoxin. The labeling chemistry is illustrated below and in the Examples.

2. Labeling Chemistry

The modified antibody or antigen binding fragment thereof provided herein are site-specifically labeled by post-translational modification of the short peptide tag (inserted or grafted or combination thereof) using PPTases or mutants thereof, including, but not limited to, Sfp, AcpS, human PPTase or *T. maritima* PPTase. Such post-translational modifications involve a PPTase catalyzed reaction between a conserved serine residue in the short peptide tag and a 4'-phosphopantetheinyl (ppan) group of coenzyme A (CoA) or a coenzyme A analogue. In this reaction, the ppan prosthetic group of CoA, or modified ppan prosthetic group of the CoA analogue, is attached to the short peptide tag through the formation of a phosphodiester bond with the hydroxyl group of the conserved serine residue of the short peptide tag which has been incorporated (i.e. inserted or grafted or combination thereof) into the antibody. The ppan or modified ppan is linked to a terminal group (TG) and the formation of the phosphodiester bond thereby conjugates the terminal group (TG) to the modified antibody or antigen binding fragment thereof via a linker which includes the ppan or modified ppan moiety.

In certain embodiments the modified antibodies or antigen binding fragment thereof provided herein are labeled by a one-step method wherein the post-translational modification occurs by reacting a CoA linked to a terminal group (TG), or a CoA analogue linked to a terminal group (TG), with the conserved serine of the short peptide tag engineered into the antibody, as shown in Schemes (Ia)-(Ic) below. Alternatively, in other embodiments of the post-translational modification of the modified antibodies or antigen binding fragment thereof provided herein, the modified antibodies or antigen binding fragment thereof are labeled by a two-step method wherein the post-translational modification involves first reacting an activated CoA or an activated CoA analogue with the conserved serine of the short peptide tag engineered into the antibody, followed by reacting a functionalized terminal group (TG) with the reactive group on the activated CoA or an activated CoA. Such two-step methods are illustrated in Schemes (IIa)-(IIf) below. In other embodiments of the post-translational modification of the modified antibodies or antigen binding fragment thereof provided herein, the modified antibodies or antigen binding fragment thereof are labeled by a three-step method, wherein the post-translational modification involves first reacting a CoA having a protected ppan prosthetic group, or a CoA analogue having protected ppan prosthetic group, with the conserved serine of the short peptide tag engineered into the antibody, thereby attaching the CoA or CoA analogue to the antibody. In the second step the protected ppan prosthetic group is deprotected thereby generating a reactive functional group on the protected ppan prosthetic group. In the third step, this reactive functional group is linked to a terminal group (TG), thereby attaching the terminal group to the modified antibody or antigen binding fragment thereof. Such three-step methods are illustrated in Schemes (IIIa)-(IIIf) below One-Step Method The One-step method used to label the modified antibodies or antigen binding fragment thereof provided herein is shown in Scheme (Ia):

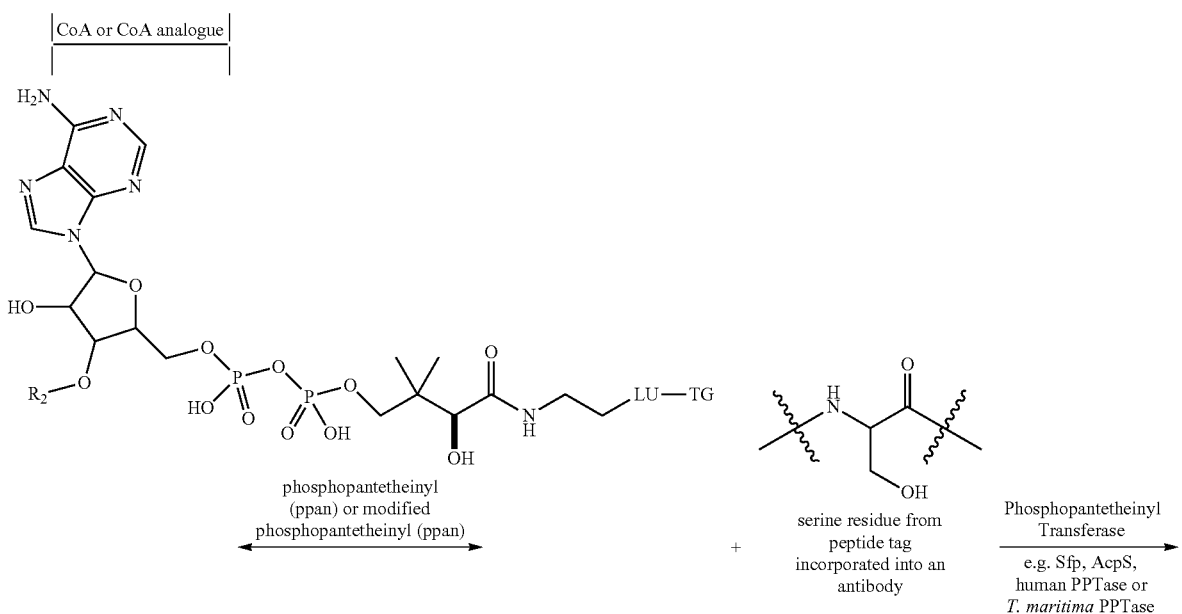

Scheme (Ia)

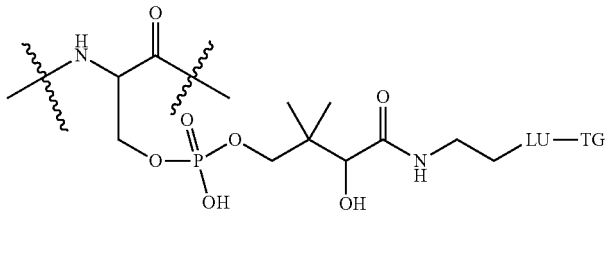 + 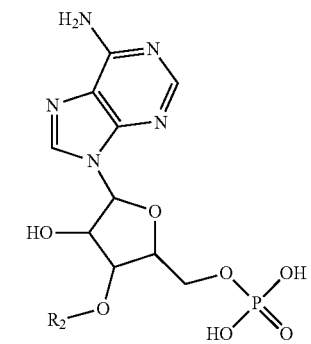

where:

$R_2$ is H or —P(=O)(OH)$_2$;

Linker Unit (LU) is a chemical moiety that links the terminal group (TG) to the modified ppan prosthetic group of the CoA analogue and terminal group (TG) is a drug moiety selected from an anti-cancer agent, an anti-inflammatory agent, an antifungal agent, an antibacterial agent, an anti-parasitic agent, an anti-viral agent, and an anesthetic agent, a biophysical probe, a fluorophore, an affinity probe, a chelator, a spectroscopic probe, a radioactive probe, a lipid molecule, a polyethylene glycol, a polymer, a spin label, DNA, RNA, a protein, a peptide, an antibody, an antibody fragment, a nanoparticle, a quantum dot, a liposome, a PLGA particle, a polysaccharide, or a surface.

In certain embodiments the Linker Unit (LU) comprises a linker selected from a non-enzymatically cleavable linker, a non-cleavable linker, an enzymatically cleavable linker, a photo stable linker, a photo-cleavable linker or any combination thereof, and the Linker Unit (LU) optionally contains a self-immolative spacer.

In certain embodiments the Linker Unit (LU) is -$L_1$-$L_2$-$L_3$-$L_4$-, wherein $L_1$ is a bond, a non-enzymatically cleavable linker, a non-cleavable linker, an enzymatically cleavable linker, a photo stable linker or a photo-cleavable linker;

$L_2$ is a bond, a non-enzymatically cleavable linker, a non-cleavable linker, an enzymatically cleavable linker, a photo stable linker or a photo-cleavable linker;

$L_3$ is a bond, a non-enzymatically cleavable linker, a non-cleavable linker, an enzymatically cleavable linker, a photo stable linker or a photo-cleavable linker, and $L_4$ is a bond, a non-enzymatically cleavable linker, a non-cleavable linker, an enzymatically cleavable linker, a photo stable linker, a photo-cleavable linker or a self-immolative spacer.

In certain embodiments the Linker Unit (LU) is -$L_1$-$L_2$-$L_3$-$L_4$-, wherein $L_1$ is a non-enzymatically cleavable linker, a non-cleavable linker, an enzymatically cleavable linker, a photo stable linker or a photo-cleavable linker;

$L_2$ is a bond, a non-enzymatically cleavable linker, a non-cleavable linker, an enzymatically cleavable linker, a photo stable linker or a photo-cleavable linker;

$L_3$ is a bond, a non-enzymatically cleavable linker, a non-cleavable linker, an enzymatically cleavable linker, a photo stable linker or a photo-cleavable linker, and $L_4$ is a bond, a non-enzymatically cleavable linker, a non-cleavable linker, an enzymatically cleavable linker, a photo stable linker, a photo-cleavable linker or a self-immolative spacer.

In certain embodiments the Linker Unit (LU) is -$L_1$-$L_2$-$L_3$-$L_4$-, wherein $L_1$ is a bond, -$A_1$-, -$A_1X^2$— or —$X^2$—; where:

$A_1$ is —C(=O)NH—, —C(=O)NH(CH$_2$)$_n$—, —C(=O)NH(C(R$^4$)$_2$)$_n$—, —(O(CH$_2$)$_n$)$_m$—, —(O(C(R$^4$)$_2$)$_n$)$_m$—, —((CH$_2$)$_n$O)$_m$—, —(((C(R$^4$)$_2$)$_n$O)$_m$—, —((CH$_2$)$_n$O)$_m$(CH$_2$)$_n$—, —(((C(R$^4$)$_2$)$_n$O)$_m$C(R$^4$)$_2$)$_n$—, —(CH$_2$)$_n$C(=O)NH—, —(C(R$^4$)$_2$)$_n$C(=O)NH—, —(CH$_2$)$_n$NHC(=O)—, —(C(R$^4$)$_2$)$_n$NHC(=O)—, —NHC(=O)(CH$_2$)$_n$—, —NHC(=O)(C(R$^4$)$_2$)$_n$—, —C(=O)NH(CH$_2$)$_n$S—, —C(=O)NH(C(R$^4$)$_2$)$_n$S—, —S(CH$_2$)$_n$C(=O)NH—, —S(C(R$^4$)$_2$)$_n$C(=O)NH—, —C(=O)NH(CH$_2$)$_n$NHC(=O)(CH$_2$)$_n$—, —C(=O)NH(C(R$^4$)$_2$)$_n$NHC(=O)(C(R$^4$)$_2$)$_n$—, —C(=O)(CH$_2$)$_n$—, —C(=O)(C(R$^4$)$_2$)$_n$—, —(CH$_2$)$_n$C(=O)—, —(C(R$^4$)$_2$)$_n$C(=O)—, —(CH$_2$)$_n$(O(CH$_2$)$_n$)$_m$NHC(=O)(CH$_2$)$_n$—, —(C(R$^4$)$_2$)$_n$(O(C(R$^4$)$_2$)$_n$)$_m$NHC(=O)(C(R$^4$)$_2$)$_n$—, —(CH$_2$)$_n$NHC(=O)(CH$_2$)$_n$—, —(C(R$^4$)$_2$)$_n$NHC(=O)(C(R$^4$)$_2$)$_n$—, —(CH$_2$)$_n$NH((CH$_2$)$_n$O)$_m$(CH$_2$)$_n$—, —(C(R$^4$)$_2$)$_n$NH((C(R$^4$)$_2$)$_n$O)$_m$(C(R$^4$)$_2$)$_n$—, —(O(CH$_2$)$_n$)$_m$NHC(=O)(CH$_2$)$_n$—, or —(O(C(R$^4$)$_2$)$_n$)$_m$NHC(=O)(C(R$^4$)$_2$)$_n$—;

each $X^2$ is independently selected from a bond,

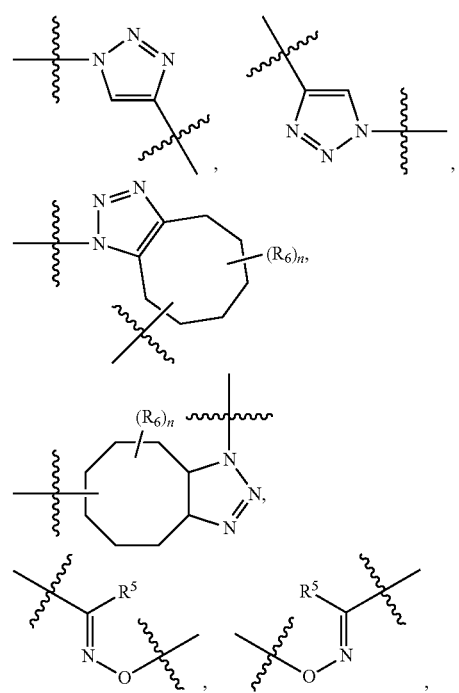

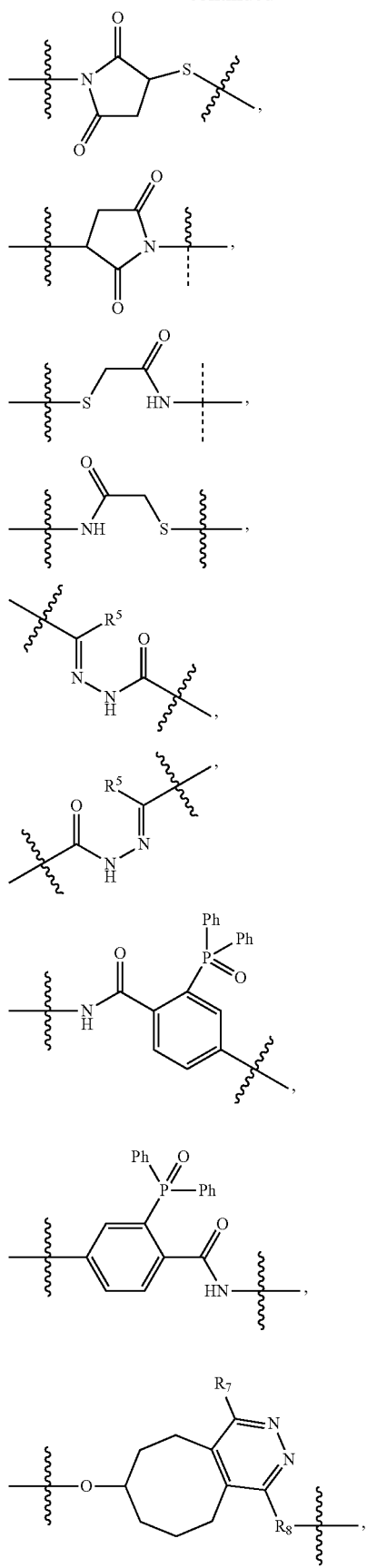
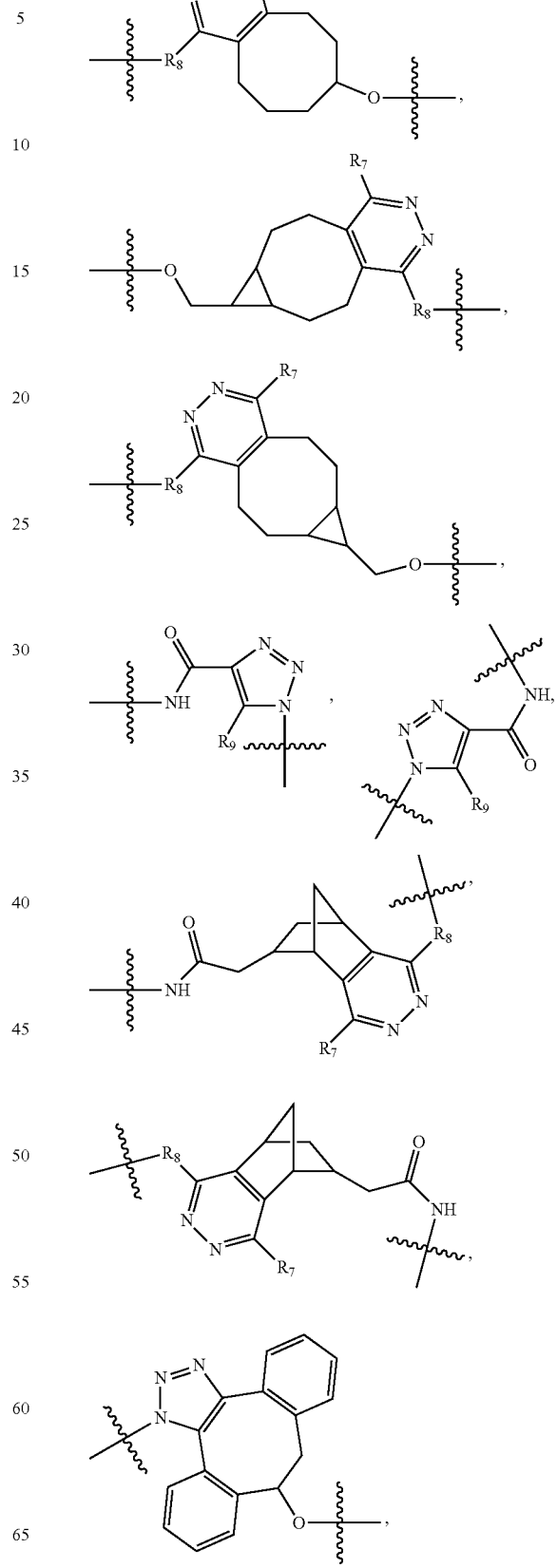

117

-continued

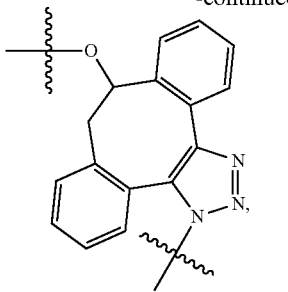

—S—, —Si(OH)₂O—,

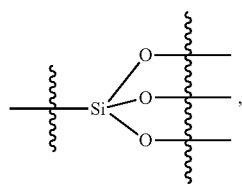

—CHR⁴(CH₂)ₙC(=O)NH—, —CHR⁴(CH₂)ₙNHC(=O)—, —C(=O)NH— and —NHC(=O)—;
each R⁴ is independently selected from H, C₁₋₄alkyl, —C(=O)OH and —OH,
each R⁵ is independently selected from H, C₁₋₄alkyl, phenyl or C₁₋₄alkyl substituted with 1 to 3 —OH groups;
each R⁶ is independently selected from H, fluoro, benzyloxy substituted with —C(=O)OH, benzyl substituted with —C(=O)OH, C₁₋₄alkoxy substituted with —C(=O)OH and C₁₋₄alkyl substituted with —C(=O)OH;
R⁷ is independently selected from H, phenyl and pyridine;
R⁸ is independently selected from

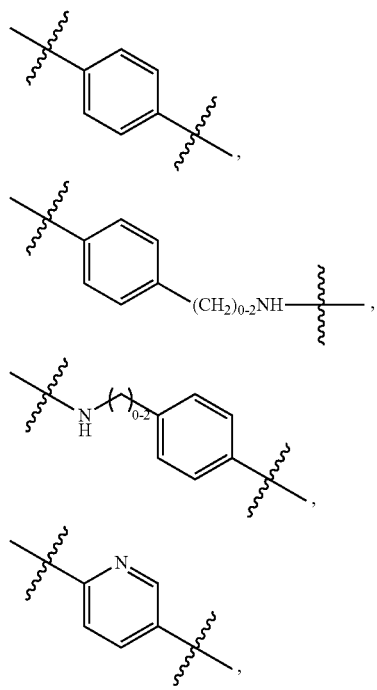

118

-continued

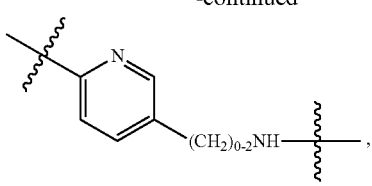

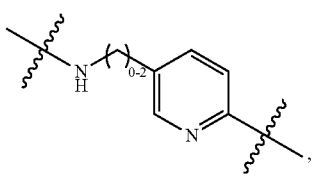

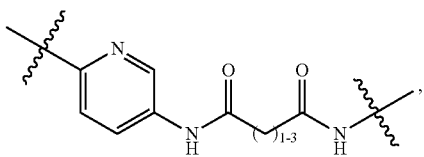

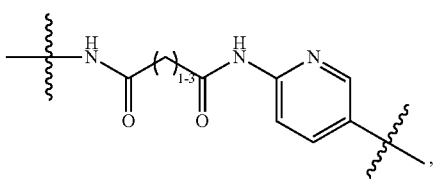

R⁹ is independently selected from H and C₁₋₆haloalkyl;
each n is independently selected from 1, 2, 3, 4, 5, 6, 7, 8 and 9, and
each m is independently selected from 1, 2, 3, 4, 5, 6, 7, 8 and 9;

L₂ is a bond, a non-enzymatically cleavable linker, a non-cleavable linker, an enzymatically cleavable linker, a photo stable linker or a photo-cleavable linker;

L₃ is a bond, a non-enzymatically cleavable linker, a non-cleavable linker, an enzymatically cleavable linker, a photo stable linker or a photo-cleavable linker, and L₄ is a bond, a non-enzymatically cleavable linker, a non-cleavable linker, an enzymatically cleavable linker, a photo stable linker, a photo-cleavable linker or a self-immolative spacer.

In certain embodiments, L₁ is C(=O)—CH₂CH₂—NH—C(=O)—CH₂CH₂—S—, so LU is —C(=O)—CH₂CH₂—NH—C(=O)—CH₂CH₂—S-L₂-L₃-L₄-.

In certain embodiments the Linker Unit (LU) is -L₁-L₂-L₃-L₄-, wherein

L₁ is a bond, -A₁-, -A₁X²— or —X²—; where:
A₁ is —C(=O)NH—, —C(=O)NH(CH₂)ₙ—, —(O(CH₂)ₙ)ₘ—, —((CH₂)ₙO)ₘ—, —((CH₂)ₙO)ₘ(CH₂)ₙ—, —(CH₂)ₙC(=O)NH—, —(CH₂)ₙNHC(=O)—, —NHC(=O)(CH₂)ₙ—, —C(=O)NH(CH₂)ₙS—, —S(CH₂)ₙC(=O)NH—, —C(=O)NH(CH₂)ₙNHC(=O)(CH₂)ₙ—, —C(=O)(CH₂)ₙ—, —(CH₂)ₙC(=O)—, —(CH₂)ₙ(O(CH₂)ₙ)ₘNHC(=O)

$(CH_2)_n-$, $-(CH_2)_nNHC(=O)(CH_2)_n-$, $-(CH_2)_nNH((CH_2)_nO)_m(CH_2)_n-$, or $-(O(CH_2)_n)_mNHC(=O)(CH_2)_n-$;
each $X^2$ is independently selected from a bond,
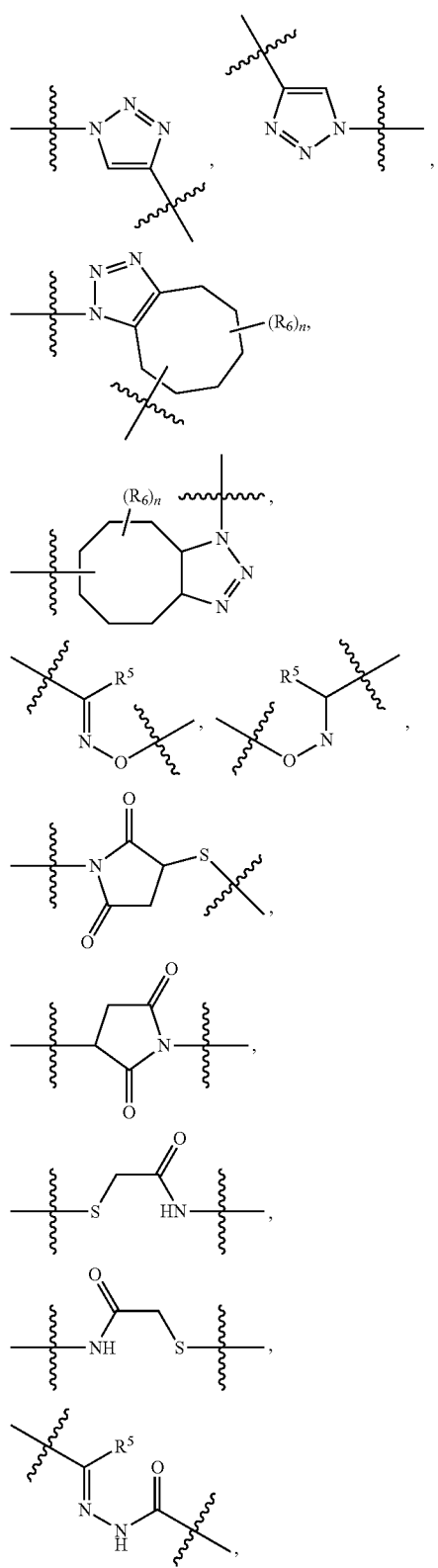
-continued
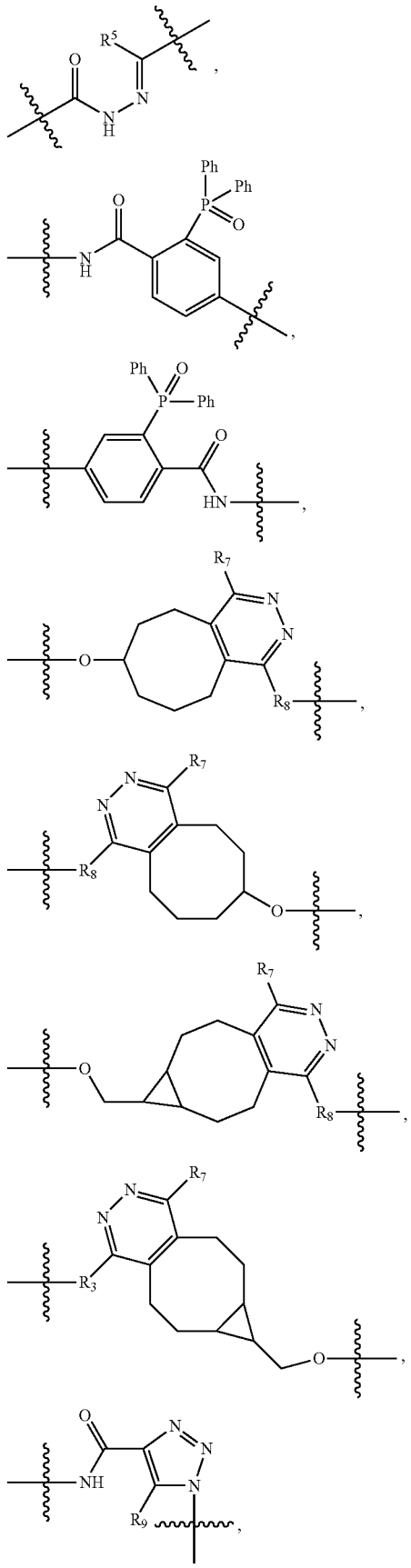

121

-continued

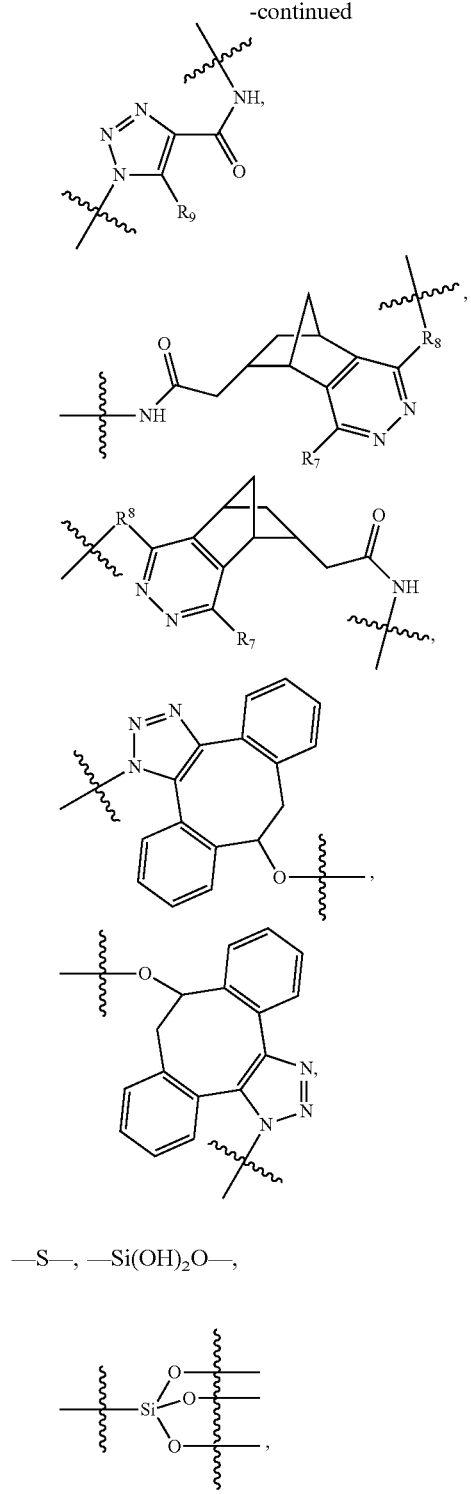

—S—, —Si(OH)₂O—,

—CHR⁴(CH₂)ₙC(=O)NH—, —CHR⁴(CH₂)ₙNHC(=O)—, —C(=O)NH— and —NHC(=O)—;
  each R⁴ is independently selected from H, C₁₋₄alkyl, —C(=O)OH and —OH,
  each R⁵ is independently selected from H, C₁₋₄alkyl, phenyl or C₇₋₄alkyl substituted with 1 to 3 —OH groups;
  each R⁶ is independently selected from H, fluoro, benzyloxy substituted with —C(=O)OH, benzyl substituted with —C(=O)OH, C₁₋₄alkoxy substituted with —C(=O)OH and C₁₋₄alkyl substituted with —C(=O)OH;
  R⁷ is independently selected from H, phenyl and pyridine;
  R⁸ is independently selected from

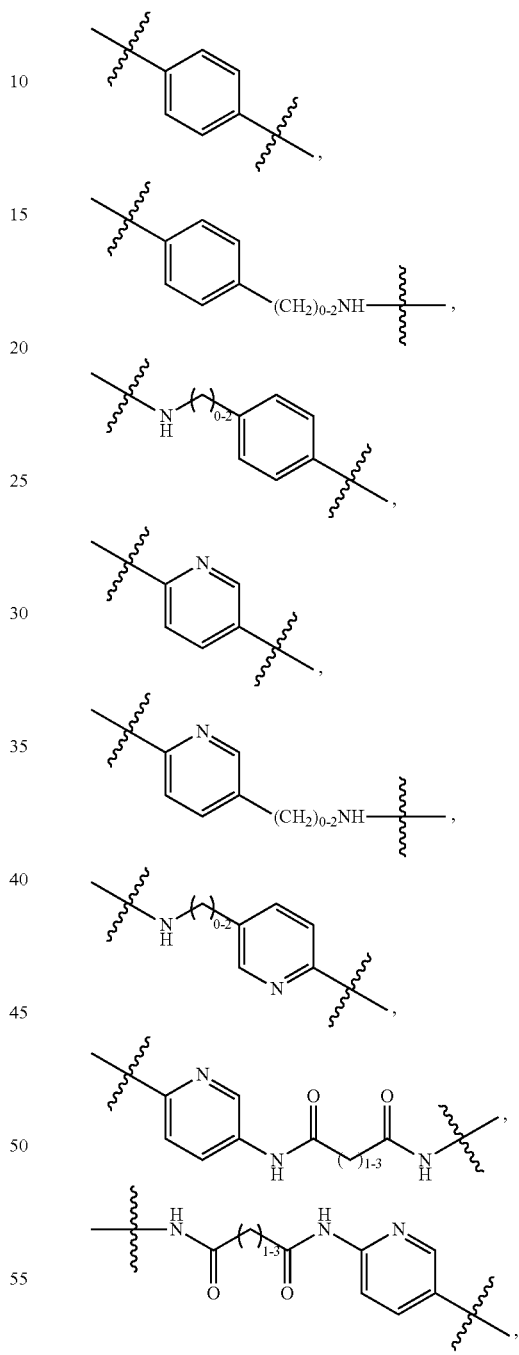

R⁹ is independently selected from H and C₁₋₆haloalkyl;
  each n is independently selected from 1, 2, 3, 4, 5, 6, 7, 8 and 9, and
  each m is independently selected from 1, 2, 3, 4, 5, 6, 7, 8 and 9;
  L₂ is a bond, a non-enzymatically cleavable linker, a non-cleavable linker, an enzymatically cleavable linker, a photo stable linker or a photo-cleavable linker;

L₃ is a bond, a non-enzymatically cleavable linker, a non-cleavable linker, an enzymatically cleavable linker, a photo stable linker or a photo-cleavable linker;

L₄ is a bond, a non-enzymatically cleavable linker, a non-cleavable linker, an enzymatically cleavable linker, a photo stable linker, a photo-cleavable linker or a self-immolative spacer.

In certain embodiments the Linker Unit (LU) is -L₁-L₂-L₃-L₄-, wherein

L₁ is a bond, -A₁-, -A₁X²— or —X²—; where:

A₁ is —C(=O)NH—, —C(=O)NH(CH₂)ₙ—, —C(=O)NH(CH₂)ₙS—, —(O(CH₂)ₙ)ₘ—, —((CH₂)ₙO)ₘ(CH₂)ₙ—, —NHC(=O)(CH₂)ₙ—, —C(=O)NH(CH₂)ₙNHC(=O)(CH₂)ₙ—, —(CH₂)ₙNH((CH₂)ₙO)ₘ(CH₂)ₙ— or —(O(CH₂)ₙ)ₘNHC(=O)(CH₂)ₙ—;

each X² is independently selected from a bond,

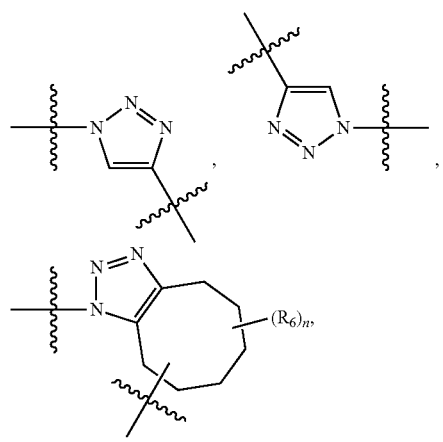

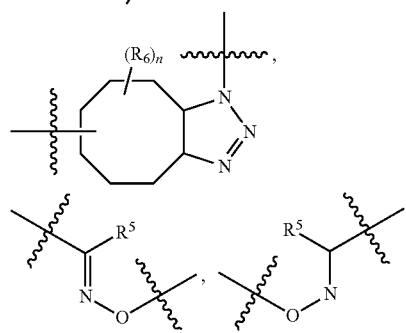

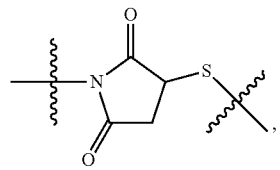

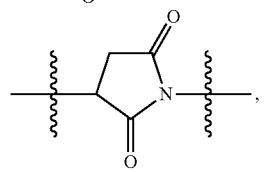

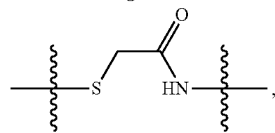

-continued

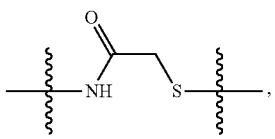

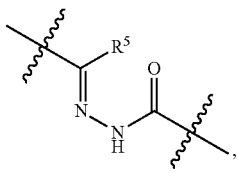

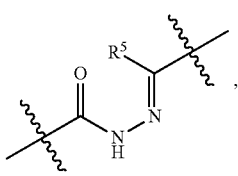

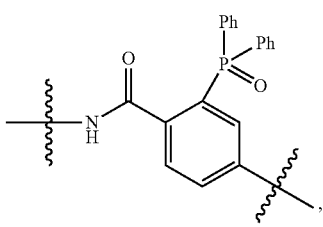

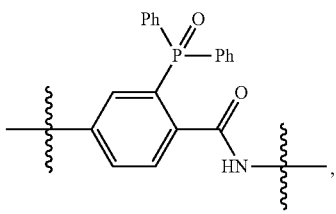

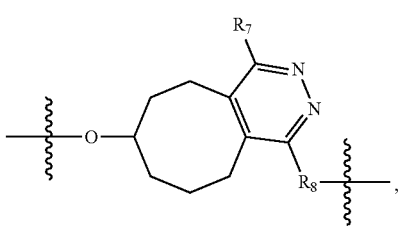

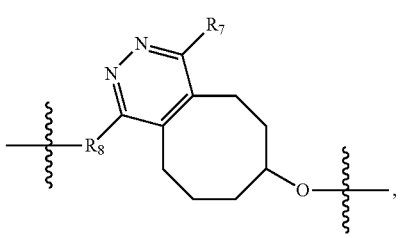

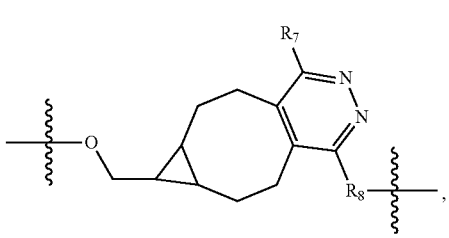

-continued

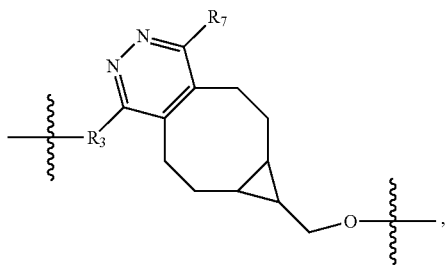

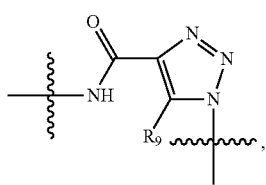

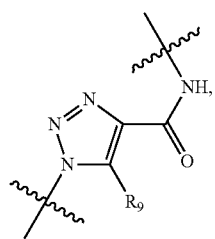

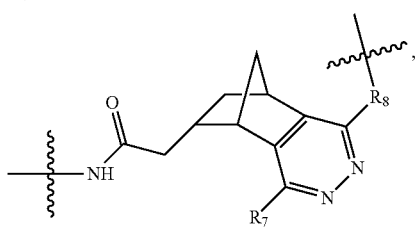

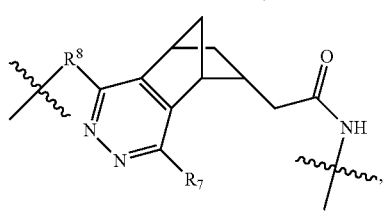

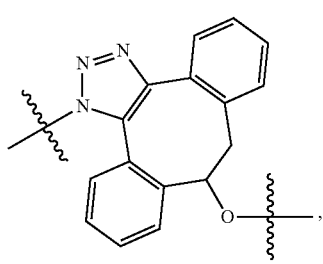

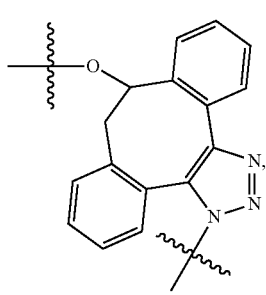

—S—, —Si(OH)$_2$O—,

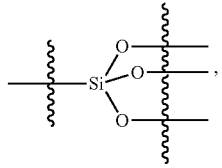

—CHR$^4$(CH$_2$)$_n$C(=O)NH—, —CHR$^4$(CH$_2$)$_n$NHC(=O)—, —C(=O)NH— and —NHC(=O)—;

each R$^4$ is independently selected from H, C$_{1-4}$alkyl, —C(=O)OH and —OH, each R$^5$ is independently selected from H, C$_{1-4}$alkyl, phenyl or C$_{1-4}$alkyl substituted with 1 to 3 —OH groups;

each R$^6$ is independently selected from H, fluoro, benzyloxy substituted with —C(=O)OH, benzyl substituted with —C(=O)OH, C$_{1-4}$alkoxy substituted with —C(=O)OH and C$_{1-4}$alkyl substituted with —C(=O)OH;

R$^7$ is independently selected from H, phenyl and pyridine;

R$^8$ is independently selected from

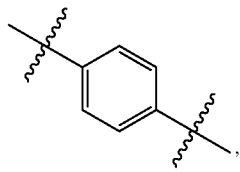

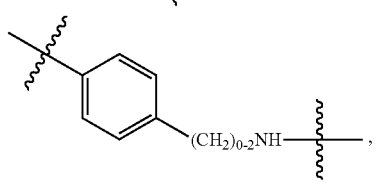

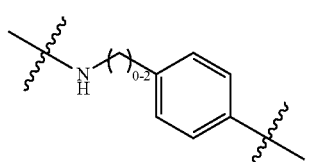

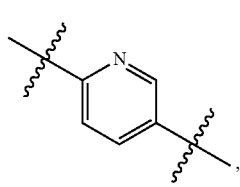

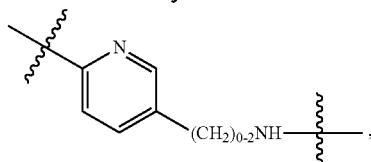

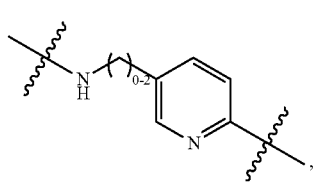

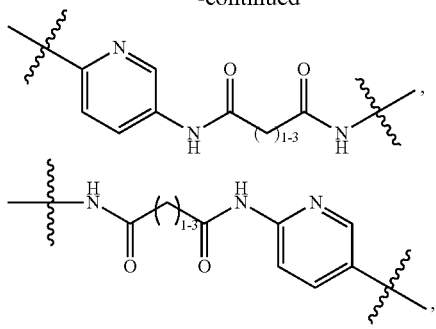

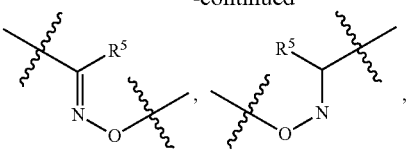

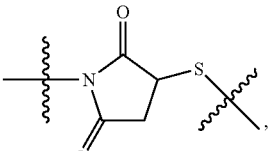

R[9] is independently selected from H and $C_{1-6}$haloalkyl;

each n is independently selected from 1, 2, 3, 4, 5, 6, 7, 8 and 9, and each m is independently selected from 1, 2, 3, 4, 5, 6, 7, 8 and 9;

$L_2$ is a bond, a non-enzymatically cleavable linker, a non-cleavable linker, an enzymatically cleavable linker, a photo stable linker or a photo-cleavable linker;

$L_3$ is a bond, a non-enzymatically cleavable linker, a non-cleavable linker, an enzymatically cleavable linker, a photo stable linker or a photo-cleavable linker, and $L_4$ is a bond, a non-enzymatically cleavable linker, a non-cleavable linker, an enzymatically cleavable linker, a photo stable linker, a photo-cleavable linker or a self-immolative spacer.

In certain embodiments the Linker Unit (LU) is -$L_1$-$L_2$-$L_3$-$L_4$-, wherein $L_1$ is a bond, -$A_1$-, -$A_1X^2$— or —$X^2$—; where:

$A_1$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —C(=O)NH(CH$_2$)$_n$NHC(=O)(CH$_2$)$_n$—, —(CH$_2$)$_n$NH((CH$_2$)$_n$O)$_m$(CH$_2$)$_n$— or —(O(CH$_2$)$_n$)$_m$NHC(=O)(CH$_2$)$_n$—;

each $X^2$ is independently selected from a bond,

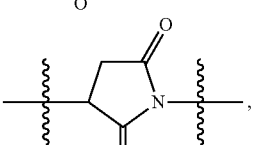

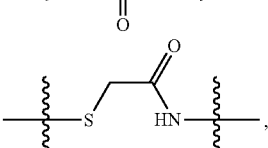

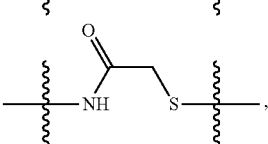

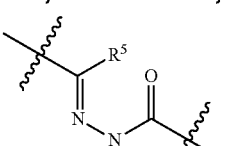

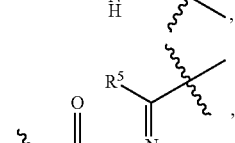

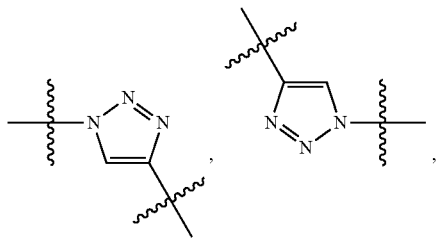

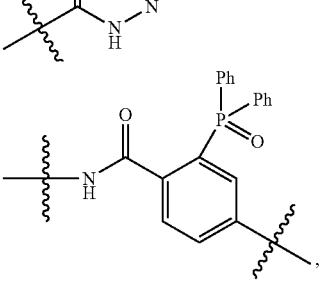

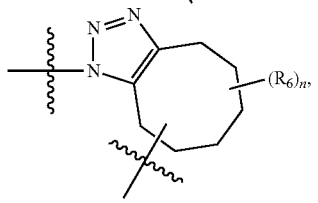

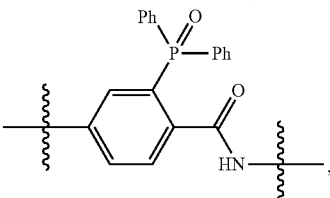

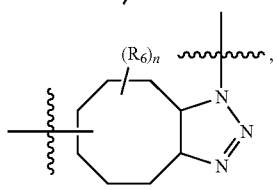

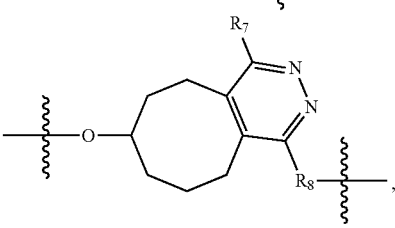

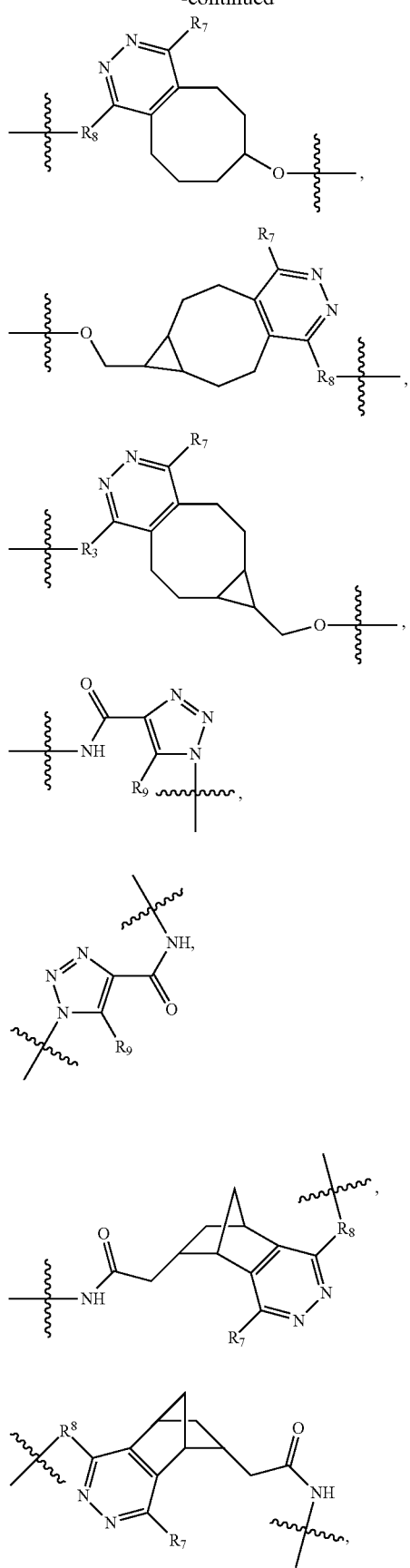

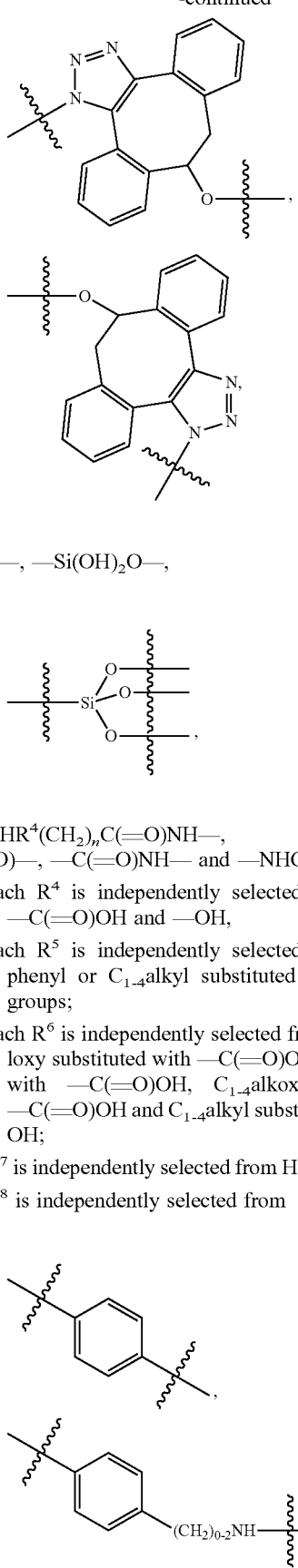

—S—, —Si(OH)$_2$O—,

—CHR$^4$(CH$_2$)$_n$C(=O)NH—, —CHR$^4$(CH$_2$)$_n$NHC(=O)—, —C(=O)NH— and —NHC(=O)—;

each R$^4$ is independently selected from H, C$_{1-4}$alkyl, —C(=O)OH and —OH, each R$^5$ is independently selected from H, C$_{1-4}$alkyl, phenyl or C$_{1-4}$alkyl substituted with 1 to 3 —OH groups;

each R$^6$ is independently selected from H, fluoro, benzyloxy substituted with —C(=O)OH, benzyl substituted with —C(=O)OH, C$_{1-4}$alkoxy substituted with —C(=O)OH and C$_{1-4}$alkyl substituted with —C(=O)OH;

R$^7$ is independently selected from H, phenyl and pyridine;

R$^8$ is independently selected from

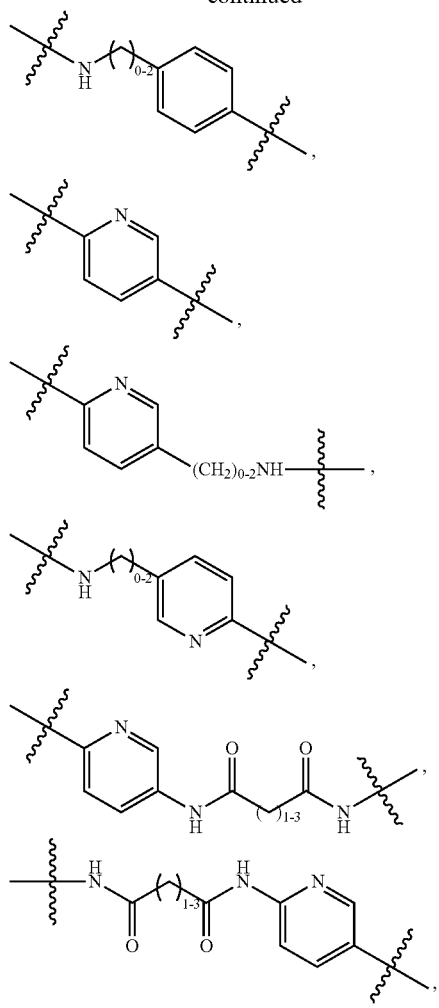

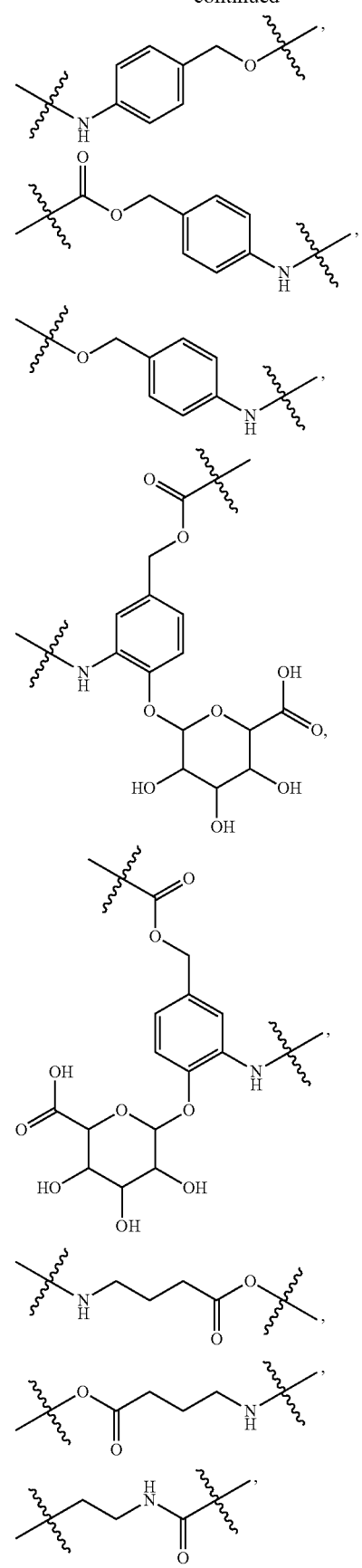

$R^9$ is independently selected from H and $C_{1-6}$haloalkyl;
each n is independently selected from 1, 2, 3, 4, 5, 6, 7, 8 and 9, and
each m is independently selected from 1, 2, 3, 4, 5, 6, 7, 8 and 9;
$L_2$ is a bond, a non-enzymatically cleavable linker or a non-cleavable linker;
$L_3$ is a bond, a non-enzymatically cleavable linker or a non-cleavable linker;
$L_4$ is a bond, an enzymatically cleavable linker or a self-immolative spacer.

In certain embodiments the Linker Unit (LU) is -$L_1$-$L_2$-$L_3$-$L_4$-, wherein
$L_1$ is a bond, -$A_1$-, -$A_1X^2$— or —$X^2$—;
$L_2$ is a bond, -$A_2$-, or -$A_2X^2$—;
$L_3$ is a bond, -$A_3$-, or -$A_3X_2$—;
$L_4$ is a bond, -$A_4$-, -$A_4X^2$—,

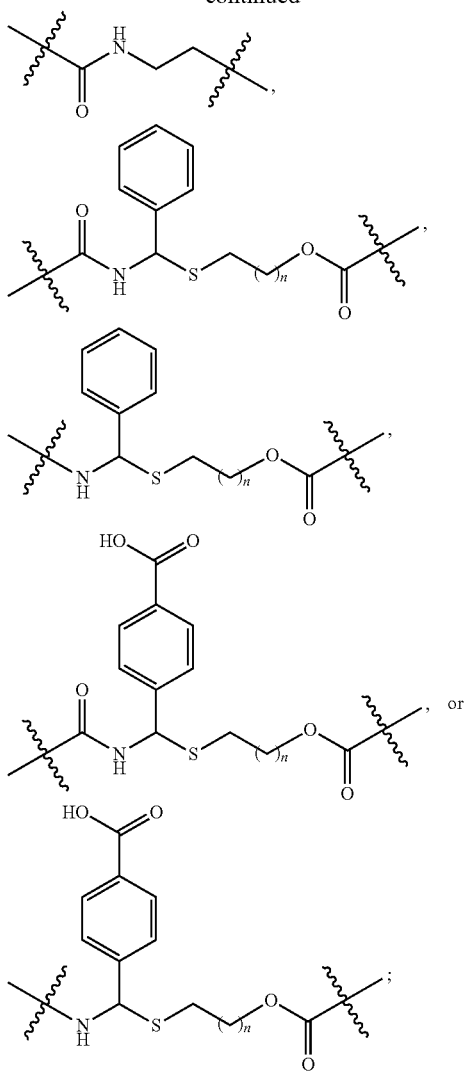

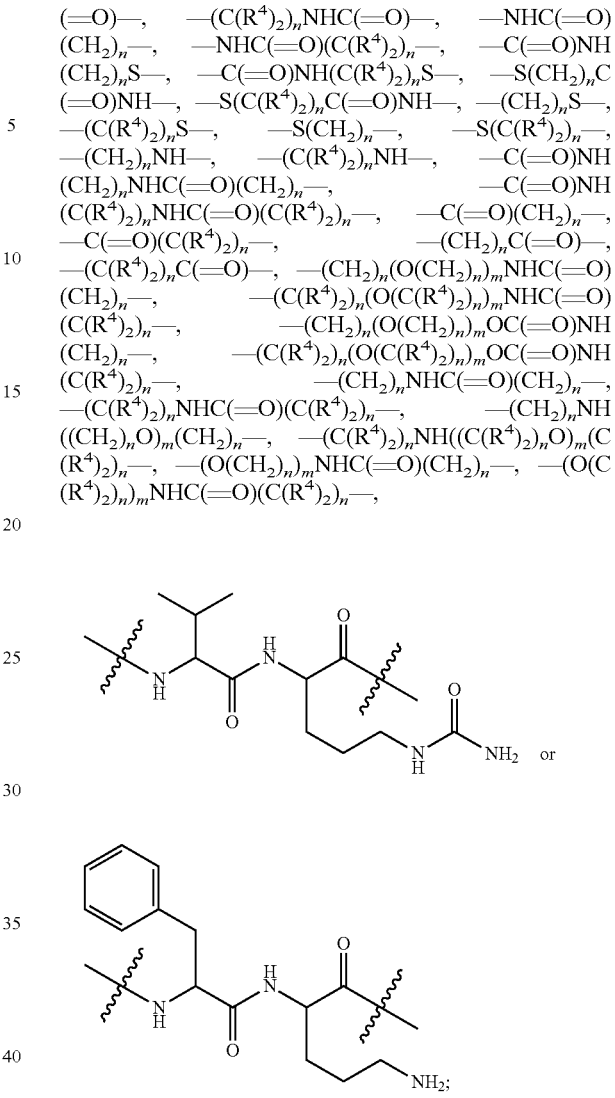

$A_1$ is —C(=O)NH—, —NHC(=O)—, —C(=O)NH(CH$_2$)$_n$—, —C(=O)NH(C(R$^4$)$_2$)$_n$—, —(O(CH$_2$)$_n$)$_m$—, —(O(C(R$^4$)$_2$)$_n$)$_m$—, —((CH$_2$)$_n$O)$_m$—, —(((C(R$^4$)$_2$)$_n$O)$_m$—, —((CH$_2$)$_n$O)$_m$(CH$_2$)$_n$—, —(((C(R$^4$)$_2$)$_n$O)$_m$C(R$^4$)$_2$)$_n$—, —(CH$_2$)$_n$C(=O)NH—, —(C(R$^4$)$_2$)$_n$C(=O)NH—, —(CH$_2$)$_n$NHC(=O)—, —(C(R$^4$)$_2$)$_n$NHC(=O)—, —NHC(=O)(CH$_2$)$_n$—, —NHC(=O)(C(R$^4$)$_2$)$_n$—, —C(=O)NH(CH$_2$)$_n$S—, —C(=O)NH(C(R$^4$)$_2$)$_n$S—, —S(CH$_2$)$_n$C(=O)NH—, —S(C(R$^4$)$_2$)$_n$C(=O)NH—, —C(=O)NH(CH$_2$)$_n$NHC(=O)(CH$_2$)$_n$—, —C(=O)NH(C(R$^4$)$_2$)$_n$NHC(=O)(C(R$^4$)$_2$)$_n$—, —C(=O)(CH$_2$)$_n$—, —C(=O)(C(R$^4$)$_2$)$_n$—, —(CH$_2$)$_n$C(=O)—, —(C(R$^4$)$_2$)$_n$C(=O)—, —(CH$_2$)$_n$(O(CH$_2$)$_n$)$_m$NHC(=O)(CH$_2$)$_n$—, —(C(R$^4$)$_2$)$_n$(O(C(R$^4$)$_2$)$_n$)$_m$NHC(=O)(C(R$^4$)$_2$)$_n$—, —(CH$_2$)$_n$NHC(=O)(CH$_2$)$_n$—, —(C(R$^4$)$_2$)$_n$NHC(=O)(C(R$^4$)$_2$)$_n$—, —(CH$_2$)$_n$NH((CH$_2$)$_n$O)$_m$(CH$_2$)$_n$—, —(C(R$^4$)$_2$)$_n$NH((C(R$^4$)$_2$)$_n$O)$_m$(C(R$^4$)$_2$)$_n$—, —(O(CH$_2$)$_n$)$_m$NHC(=O)(CH$_2$)$_n$—, or —(O(C(R$^4$)$_2$)$_n$)$_m$NHC(=O)(C(R$^4$)$_2$)$_n$—;

$A_2$ is —C(=O)NH—, —C(=O)NH(CH$_2$)$_n$—, —C(=O)NH(C(R$^4$)$_2$)$_n$—, —(O(CH$_2$)$_n$)$_m$—, —(O(C(R$^4$)$_2$)$_n$)$_m$—, —((CH$_2$)$_n$O)$_m$—, —(((C(R$^4$)$_2$)$_n$O)$_m$—, —((CH$_2$)$_n$O)$_m$(CH$_2$)$_n$—, —(((C(R$^4$)$_2$)$_n$O)$_m$C(R$^4$)$_2$)$_n$—, —(CH$_2$)$_n$C(=O)NH—, —(C(R$^4$)$_2$)$_n$C(=O)NR$^4$—, —(CH$_2$)$_n$NHC(=O)—, —(C(R$^4$)$_2$)$_n$NHC(=O)—, —NHC(=O)(CH$_2$)$_n$—, —NHC(=O)(C(R$^4$)$_2$)$_n$—, —C(=O)NH(CH$_2$)$_n$S—, —C(=O)NH(C(R$^4$)$_2$)$_n$S—, —S(CH$_2$)$_n$C(=O)NH—, —S(C(R$^4$)$_2$)$_n$C(=O)NH—, —(CH$_2$)$_n$S—, —(C(R$^4$)$_2$)$_n$S—, —S(CH$_2$)$_n$—, —S(C(R$^4$)$_2$)$_n$—, —(CH$_2$)$_n$NH—, —(C(R$^4$)$_2$)$_n$NH—, —C(=O)NH(CH$_2$)$_n$NHC(=O)(CH$_2$)$_n$—, —C(=O)NH(C(R$^4$)$_2$)$_n$NHC(=O)(C(R$^4$)$_2$)$_n$—, —C(=O)(CH$_2$)$_n$—, —C(=O)(C(R$^4$)$_2$)$_n$—, —(CH$_2$)$_n$C(=O)—, —(C(R$^4$)$_2$)$_n$C(=O)—, —(CH$_2$)$_n$(O(CH$_2$)$_n$)$_m$NHC(=O)(CH$_2$)$_n$—, —(C(R$^4$)$_2$)$_n$(O(C(R$^4$)$_2$)$_n$)$_m$NHC(=O)(C(R$^4$)$_2$)$_n$—, —(CH$_2$)$_n$(O(CH$_2$)$_n$)$_m$OC(=O)NH(CH$_2$)$_n$—, —(C(R$^4$)$_2$)$_n$(O(C(R$^4$)$_2$)$_n$)$_m$OC(=O)NH(C(R$^4$)$_2$)$_n$—, —(CH$_2$)$_n$NHC(=O)(CH$_2$)$_n$—, —(C(R$^4$)$_2$)$_n$NHC(=O)(C(R$^4$)$_2$)$_n$—, —(CH$_2$)$_n$NH((CH$_2$)$_n$O)$_m$(CH$_2$)$_n$—, —(C(R$^4$)$_2$)$_n$NH((C(R$^4$)$_2$)$_n$O)$_m$(C(R$^4$)$_2$)$_n$—, —(O(CH$_2$)$_n$)$_m$NHC(=O)(CH$_2$)$_n$—, —(O(C(R$^4$)$_2$)$_n$)$_m$NHC(=O)(C(R$^4$)$_2$)$_n$—, $A_3$ is —C(=O)NH—, —C(=O)NH(CH$_2$)$_n$—, —C(=O)NH(C(R$^4$)$_2$)$_n$—, —(O(CH$_2$)$_n$)$_m$—, —(O(C(R$^4$)$_2$)$_n$)$_m$—, —((CH$_2$)$_n$O)$_m$—, —(((C(R$^4$)$_2$)$_n$O)$_m$—, —((CH$_2$)$_n$O)$_m$(CH$_2$)$_n$—, —(((C(R$^4$)$_2$)$_n$O)$_m$C(R$^4$)$_2$)$_n$—, —(CH$_2$)$_n$C(=O)NH—, —(C(R$^4$)$_2$)$_n$C(=O)NH—, —(CH$_2$)$_n$NHC(=O)—, —(C(R$^4$)$_2$)$_n$NHC(=O)—, —NHC(=O)(CH$_2$)$_n$—, —NHC(=O)(C(R$^4$)$_2$)$_n$—, —C(=O)NH(CH$_2$)$_n$S—, —C(=O)NH(C(R$^4$)$_2$)$_n$S—, —S(CH$_2$)$_n$C(=O)NH—, —S(C(R$^4$)$_2$)$_n$C(=O)NH—, —(CH$_2$)$_n$S—, —(C(R$^4$)$_2$)$_n$S—, —S(CH$_2$)$_n$—, —S(C(R$^4$)$_2$)$_n$—, —C(=O)NH(CH$_2$)$_n$NHC(=O)(CH$_2$)$_n$—, —C(=O)NH(C(R$^4$)$_2$)$_n$NHC(=O)(C(R$^4$)$_2$)$_n$—, —C(=O)(CH$_2$)$_n$—, —C(=O)(C(R$^4$)$_2$)$_n$—, —(CH$_2$)$_n$C(=O)—, —(C(R$^4$)$_2$)$_n$C(=O)—, —(CH$_2$)$_n$(O(CH$_2$)$_n$)$_m$NHC(=O)(CH$_2$)$_n$—, —(C(R$^4$)$_2$)$_n$(O(C(R$^4$)$_2$)$_m$ NHC(=O)(C(R$^4$)$_2$)$_n$—, —(CH$_2$)$_n$(O(CH$_2$)$_n$)$_m$OC(=O)NH(CH$_2$)$_n$—, —(C(R$^4$)$_2$)$_n$(O(C(R$^4$)$_2$)$_n$)$_m$OC(=O)NH(C(R$^4$)$_2$)$_n$—, —(CH$_2$)$_n$(O(CH$_2$)$_n$)$_m$OC(=O)—, —(C(R$^4$)$_2$)$_n$(O(C(R$^4$)$_2$)$_n$)$_m$C(=O)—, —(CH$_2$)$_n$O(CH$_2$)$_n$)$_m$C(=O)—, —(C(R$^4$)$_2$)$_n$(O(C(R$^4$)$_2$)$_n$)$_m$C(=O)—, —(CH$_2$)$_n$NHC(=O)(CH$_2$)$_n$—, —(C(R$^4$)$_2$)$_n$NHC(=O)(C(R$^4$)$_2$)$_n$—, —(O(CH$_2$)$_n$)$_m$NHC(=O)(CH$_2$)$_n$—, —(O(C(R$^4$)$_2$)$_n$)$_m$NHC(=O)(C(R$^4$)$_2$)$_n$—,

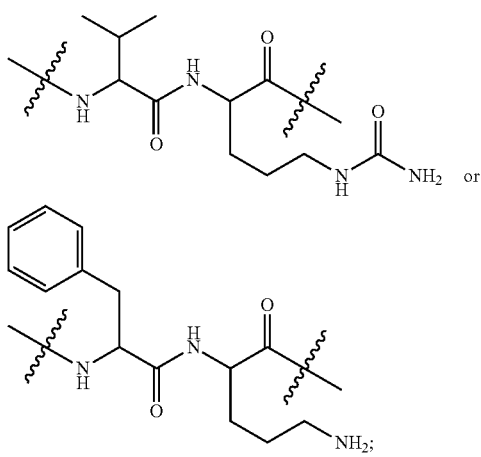

or

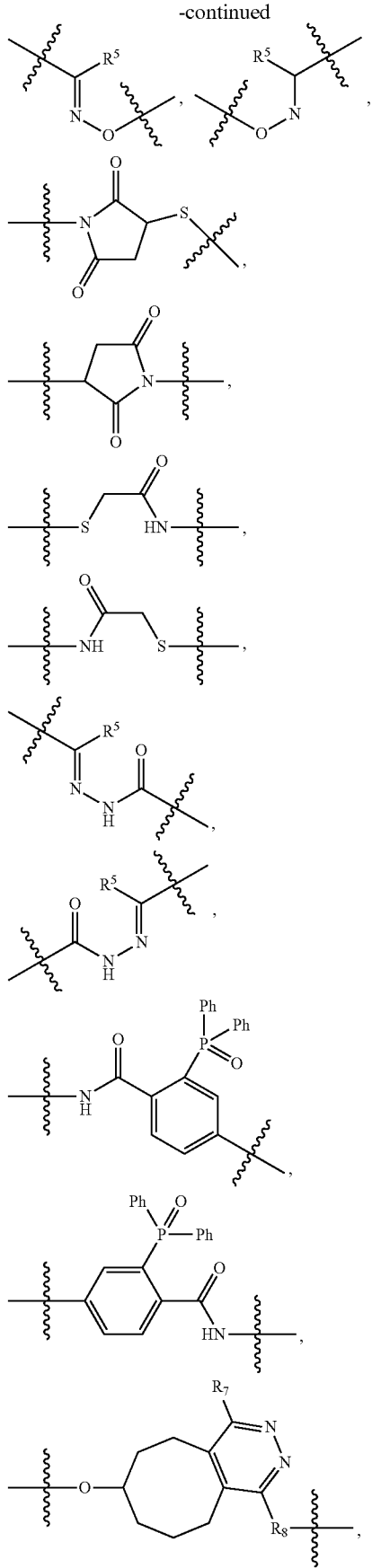

$A_4$ is —C(=O)NH—, —C(=O)NH(CH$_2$)$_n$—, —C(=O)NH(C(R$^4$)$_2$)$_n$—, —(O(CH$_2$)$_n$)$_m$—, —(O(C(R$^4$)$_2$)$_n$)$_m$—, —((CH$_2$)$_n$O)$_m$—, —(((C(R$^4$)$_2$)$_n$O)$_m$—, —((CH$_2$)$_n$O)$_m$(CH$_2$)$_n$—, —O(C(R$^4$)$_2$)$_n$O)$_m$C(R$^4$)$_2$)$_n$—, —(CH$_2$)$_n$C(=O)NH—, —(C(R$^4$)$_2$)$_n$C(=O)NH—, —(CH$_2$)$_n$NHC(=O)—, —(C(R$^4$)$_2$)$_n$NHC(=O)—, —NHC(=O)(CH$_2$)$_n$—, —NHC(=O)(C(R$^4$)$_2$)$_n$—, —C(=O)NH(CH$_2$)$_n$S—, —C(=O)NH(C(R$^4$)$_2$)$_n$S—, —S(CH$_2$)$_n$C(=O)NH—, —S(C(R$^4$)$_2$)$_n$C(=O)NH—, —C(=O)NH(CH$_2$)$_n$NHC(=O)(CH$_2$)$_n$—, —C(=O)NH(C(R$^4$)$_2$)$_n$NHC(=O)(C(R$^4$)$_2$)$_n$—, —C(=O)(CH$_2$)$_n$—, —C(=O)(C(R$^4$)$_2$)$_n$—, —(CH$_2$)$_n$C(=O)—, —(C(R$^4$)$_2$)$_n$C(=O)—, —(CH$_2$)$_n$(O(CH$_2$)$_n$)$_m$NHC(=O)(CH$_2$)$_n$—, —(C(R$^4$)$_2$)$_n$(O(C(R$^4$)$_2$)$_n$)$_m$NHC(=O)(C(R$^4$)$_2$)$_n$—, —(CH$_2$)$_n$NHC(=O)(CH$_2$)$_n$—, —(C(R$^4$)$_2$)$_n$NHC(=O)(C(R$^4$)$_2$)$_n$—, —(CH$_2$)$_n$NH((CH$_2$)$_n$O)$_m$(CH$_2$)$_n$—, —(C(R$^4$)$_2$)$_n$NH((C(R$^4$)$_2$)$_n$O)$_m$(C(R$^4$)$_2$)$_n$—, —(O(CH$_2$)$_n$)$_m$NHC(=O)(CH$_2$)$_n$—, or —(O(C(R$^4$)$_2$)$_n$)$_m$NHC(=O)(C(R$^4$)$_2$)$_n$—;

each $X^2$ is independently selected from a bond,

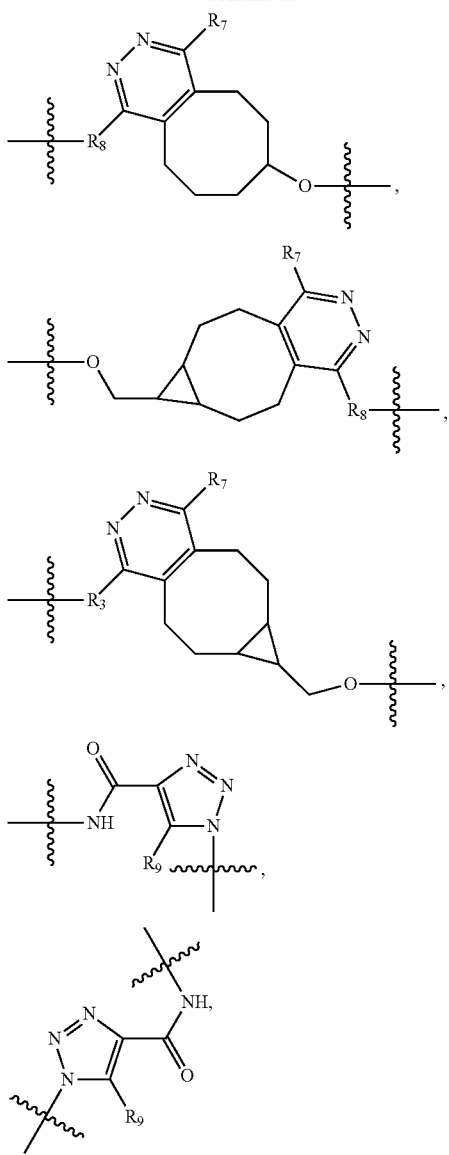

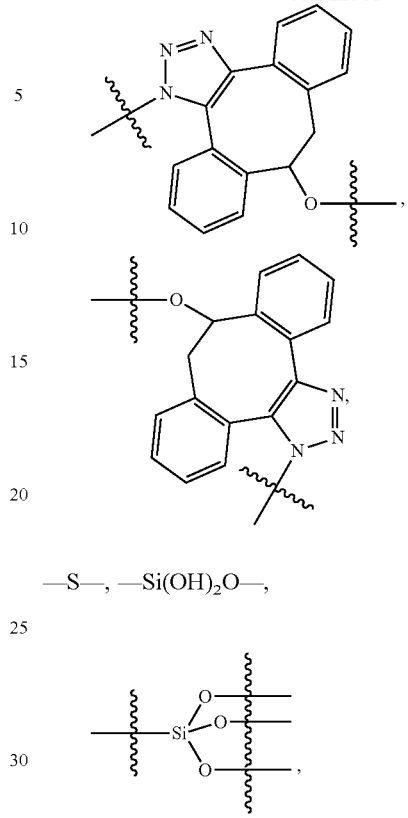

—S—, —Si(OH)$_2$O—,

—CHR$^4$(CH$_2$)$_n$C(=O)NH—, —CHR$^4$(CH$_2$)$_n$NHC(=O)—, —C(=O)NH— and —NHC(=O)—;

each R$^4$ is independently selected from H, C$_{1-4}$alkyl, —C(=O)OH and —OH, each R$^5$ is independently selected from H, C$_{1-4}$alkyl, phenyl or C$_{1-4}$alkyl substituted with 1 to 3 —OH groups;

each R$^6$ is independently selected from H, fluoro, benzyloxy substituted with —C(=O)OH, benzyl substituted with —C(=O)OH, C$_{1-4}$alkoxy substituted with —C(=O)OH and C$_{1-4}$alkyl substituted with —C(=O)OH;

R$^7$ is independently selected from H, phenyl and pyridine;

R$^8$ is independently selected from

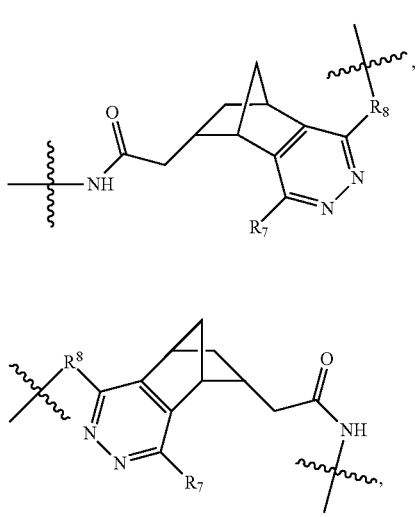

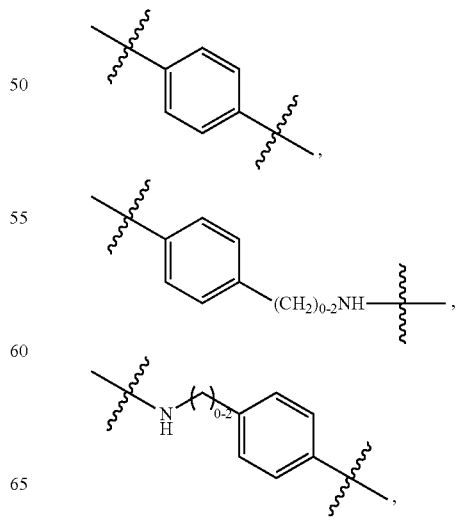

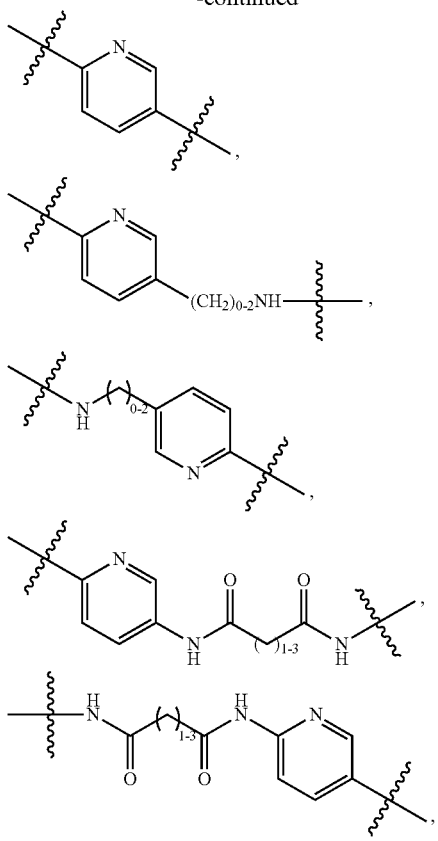

R[9] is independently selected from H and $C_{1-6}$haloalkyl;

each n is independently selected from 1, 2, 3, 4, 5, 6, 7, 8 and 9, and each m is independently selected from 1, 2, 3, 4, 5, 6, 7, 8 and 9.

In certain embodiments the Linker Unit (LU) is -$L_1$-$L_2$-$L_3$-$L_4$-, wherein $L_1$ is a bond, -$A_1$-, -$A_1X^2$— or —$X^2$—;

$L_2$ is a bond, -$A_2$-, or -$A_2X^2$—;

$L_3$ is a bond, -$A_3$-, or -$A_3X^2$—;

$L_4$ is a bond, -$A_4$-, -$A_4X^2$—,

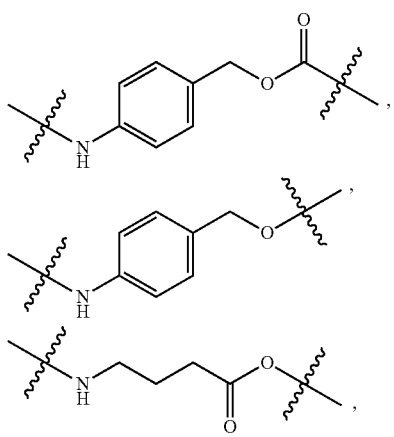

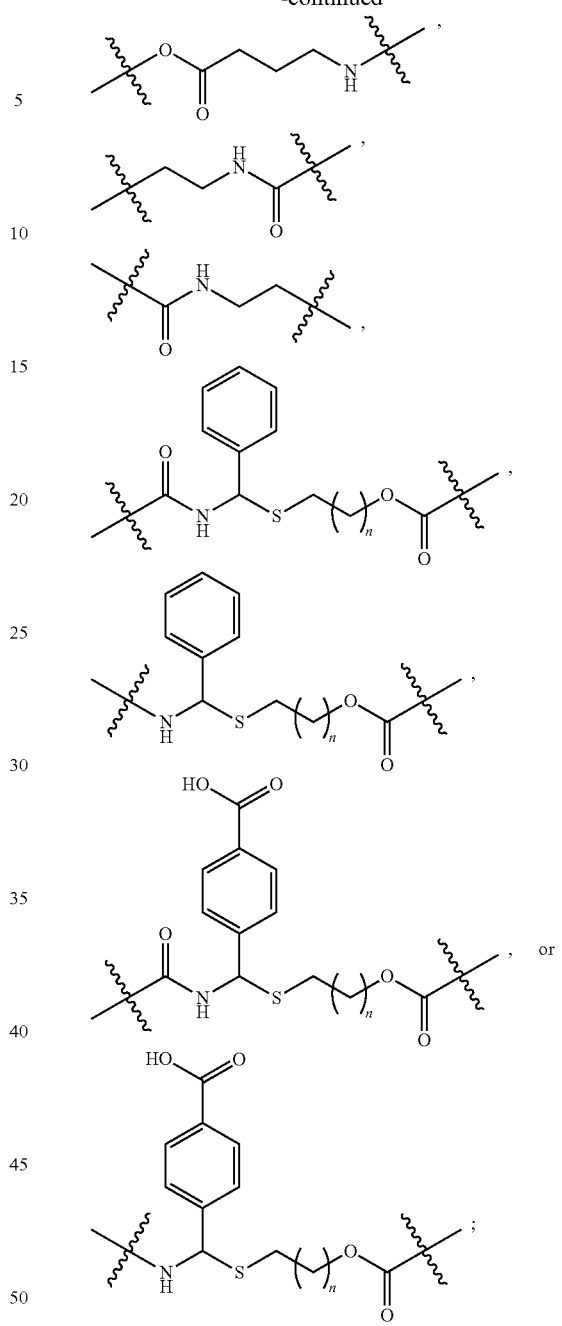

$A_1$ is —C(=O)NH—, —C(=O)NH(CH$_2$)$_n$—, —(O(CH$_2$)$_n$)$_m$—, —((CH$_2$)$_n$O)$_m$—, —((CH$_2$)$_n$O)$_m$(CH$_2$)$_n$—, —(CH$_2$)$_n$C(=O)NH—, —NHC(=O)(CH$_2$)$_n$—, —(CH$_2$)$_n$NHC(=O)—, —C(=O)NH(CH$_2$)$_n$S—, —S(CH$_2$)$_n$C(=O)NH—, —C(=O)NH(CH$_2$)$_n$NHC(=O)(CH$_2$)$_n$—, —C(=O)(CH$_2$)$_n$—, —(CH$_2$)$_n$C(=O)—, —(CH$_2$)$_n$(O(CH$_2$)$_n$)$_m$NHC(=O)(CH$_2$)$_n$—, —(CH$_2$)$_n$NHC(=O)(CH$_2$)$_n$—, —(CH$_2$)$_n$NH((CH$_2$)$_n$O)$_m$(CH$_2$)$_n$— or —(O(CH$_2$)$_n$)$_n$NHC(=O)(CH$_2$)$_n$—;

$A_2$ is —C(=O)NH—, —C(=O)NH(CH$_2$)$_n$—, —(O(CH$_2$)$_n$)$_m$—, —((CH$_2$)$_n$O)$_m$—, —((CH$_2$)$_n$O)$_m$(CH$_2$)$_n$—, —(CH$_2$)$_n$C(=O)NH—, —NHC(=O)(CH$_2$)$_n$—, —(CH$_2$)$_n$NHC(=O)—, —C(=O)NH(CH$_2$)$_n$S—, —S(CH$_2$)$_n$C(=O)NH—, —C(=O)NH $(CH_2)_nNHC(=O)(CH_2)_n-$, $-C(=O)(CH_2)_n-$, $-(CH_2)_nC(=O)-$, $-(CH_2)_n(O(CH_2)_n)_mNHC(=O)(CH_2)_n-$, $-(CH_2)_nNHC(=O)(CH_2)_n-$, $-(CH_2)_nNH((CH_2)_nO)_m(CH_2)_n-$, $-(O(CH_2)_n)_mNHC(=O)(CH_2)_n-$ or

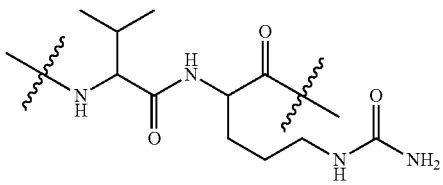

$A_3$ is $-C(=O)NH-$, $-C(=O)NH(CH_2)_n-$, $-(O(CH_2)_n)_m-$, $-((CH_2)_nO)_m-$, $-((CH_2)_nO)_m(CH_2)_n-$, $-(CH_2)_nC(=O)NH-$, $-NHC(=O)(CH_2)_n-$, $-(CH_2)_nNHC(=O)-$, $-C(=O)NH(CH_2)_nS-$, $-S(CH_2)_nC(=O)NH-$, $-C(=O)NH(CH_2)_nNHC(=O)(CH_2)_n-$, $-C(=O)(CH_2)_n-$, $-(CH_2)_nC(=O)-$, $-(CH_2)_n(O(CH_2)_n)_mNHC(=O)(CH_2)_n-$, $-(CH_2)_nNHC(=O)(CH_2)_n-$, $-(CH_2)_nNH((CH_2)_nO)_m(CH_2)_n-$, $-(O(CH_2)_n)_mNHC(=O)(CH_2)_n-$ or

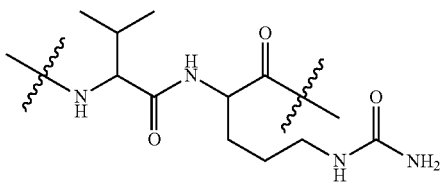

$A_4$-$C(=O)NH-$, $-C(=O)NH(CH_2)_n-$, $-(O(CH_2)_n)_m-$, $-((CH_2)_nO)_m-$, $-((CH_2)_nO)_m(CH_2)_n-$, $-(CH_2)_nC(=O)NH-$, $-NHC(=O)(CH_2)_n-$, $-(CH_2)_nNHC(=O)-$, $-C(=O)NH(CH_2)_nS-$, $-S(CH_2)_nC(=O)NH-$, $-C(=O)NH(CH_2)_nNHC(=O)(CH_2)_n-$, $-C(=O)(CH_2)_n-$, $-(CH_2)_nC(=O)-$, $-(CH_2)_n(O(CH_2)_n)_mNHC(=O)(CH_2)_n-$, $-(CH_2)_nNHC(=O)(CH_2)_n-$, $-(CH_2)_nNH((CH_2)_nO)_m(CH_2)_n-$ or $-(O(CH_2)_n)_mNHC(=O)(CH_2)_n-$;

each $X^2$ is independently selected from a bond,

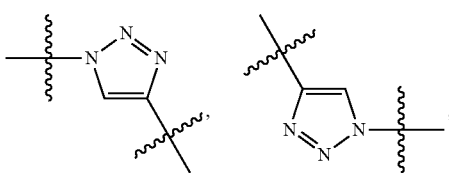

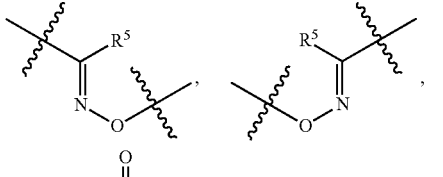

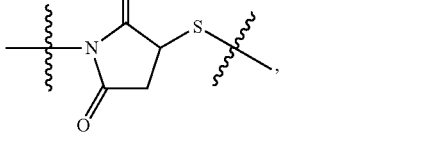

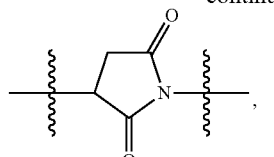

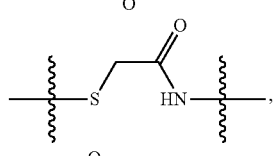

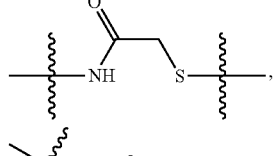

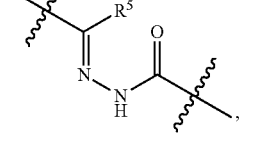

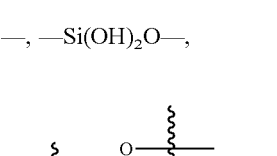

$-S-$, $-Si(OH)_2O-$,

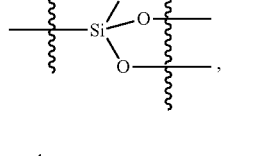

$-CHR^4(CH_2)_nC(=O)NH-$, $-CHR^4(CH_2)_nNHC(=O)-$, $-C(=O)NH-$ and $-NHC(=O)-$;

each $R^4$ is independently selected from H, $C_{1-4}$alkyl, $-C(=O)OH$ and $-OH$, each $R^5$ is independently selected from H, $C_{1-4}$alkyl, phenyl or $C_{1-4}$alkyl substituted with 1 to 3 $-OH$ groups;

each n is independently selected from 1, 2, 3, 4, 5, 6, 7, 8 and 9, and each m is independently selected from 1, 2, 3, 4, 5, 6, 7, 8 and 9.

In certain embodiments the Linker Unit (LU) is -$L_1$-$L_2$-$L_3$-$L_4$-, wherein $L_1$ is a bond, -$A_1$-, -$A_1X^2$— or —$X^2$—;
$L_2$ is a bond, -$A_2$-, or -$A_2X^2$—;
$L_3$ is a bond, -$A_3$-, or -$A_3X^2$—;
$L_4$ is a bond, -$A_4$-, -$A_4X^2$—,

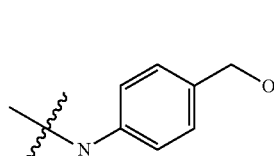

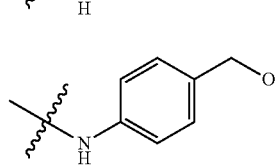

-continued

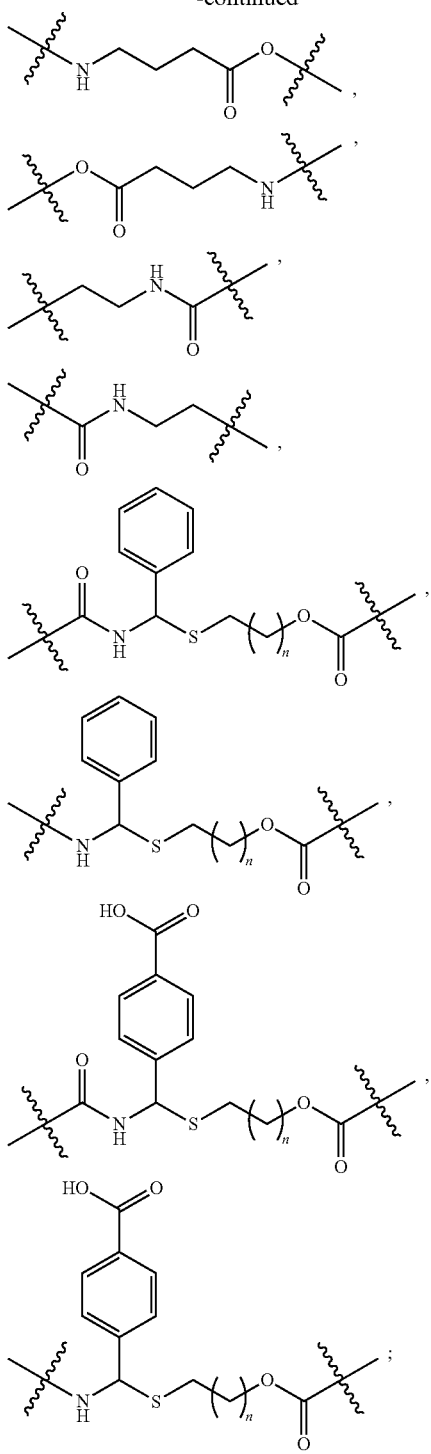

$A_1$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$— or —(O(CH$_2$)$_n$)$_m$NHC(=O)(CH$_2$)$_n$—;

$A_2$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$—, —(O(CH$_2$)$_n$)$_m$NHC(=O)(CH$_2$)$_n$— or

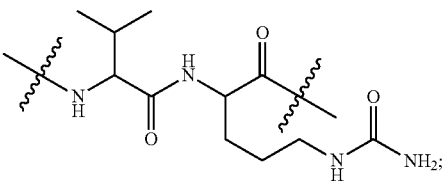 [SMILES: *NC(C(=O)NC(CCCNC(N)=O)C(*)=O)C(C)C]

$A_3$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$, —(O(CH$_2$)$_n$)$_m$NHC(=O)(CH$_2$)$_n$— or

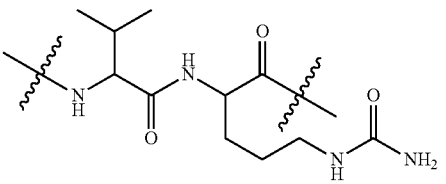 [SMILES: *NC(C(=O)NC(CCCNC(N)=O)C(*)=O)C(C)C]

$A_4$ is —C(=O)NH—, —C(=O)NH(CH$_2$)$_n$—, —C(=O)NH(CH$_2$)$_n$S—, —(O(CH$_2$)$_n$)$_m$—, —((CH$_2$)$_n$O)$_m$(CH$_2$)$_n$—, —NHC(=O)(CH$_2$)$_n$—, —(CH$_2$)$_n$NHC(=O)—, —C(=O)NH(CH$_2$)$_n$NHC(=O)(CH$_2$)$_n$—, —(CH$_2$)$_n$NH((CH$_2$)$_n$O)$_m$(CH$_2$)$_n$— or —(O(CH$_2$)$_n$)$_m$NHC(=O)(CH$_2$)$_n$—;

each $X^2$ is independently selected from a bond,

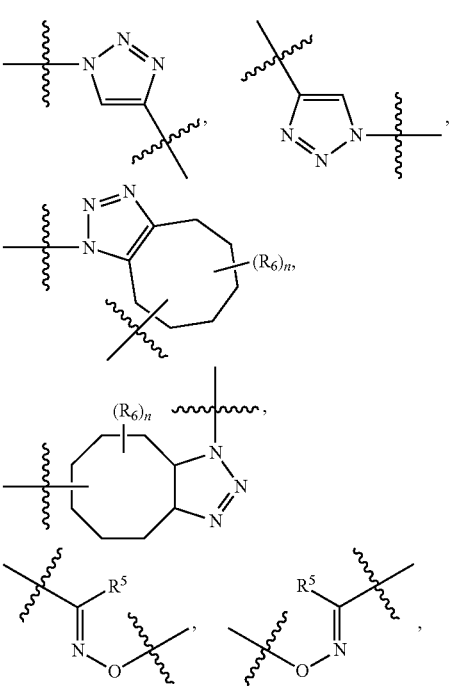

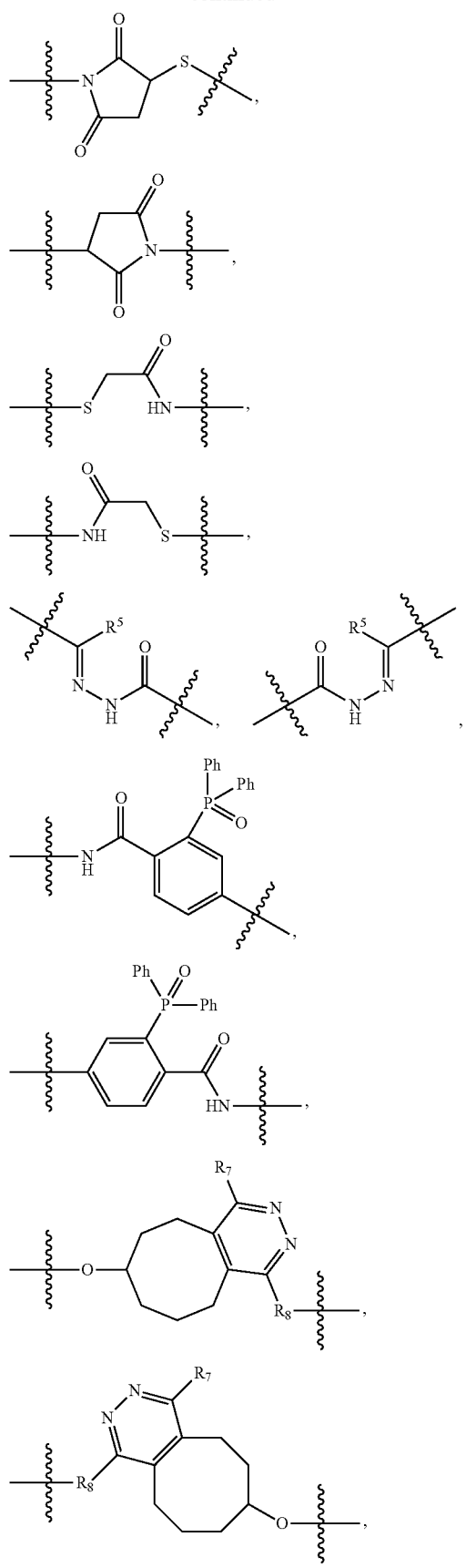
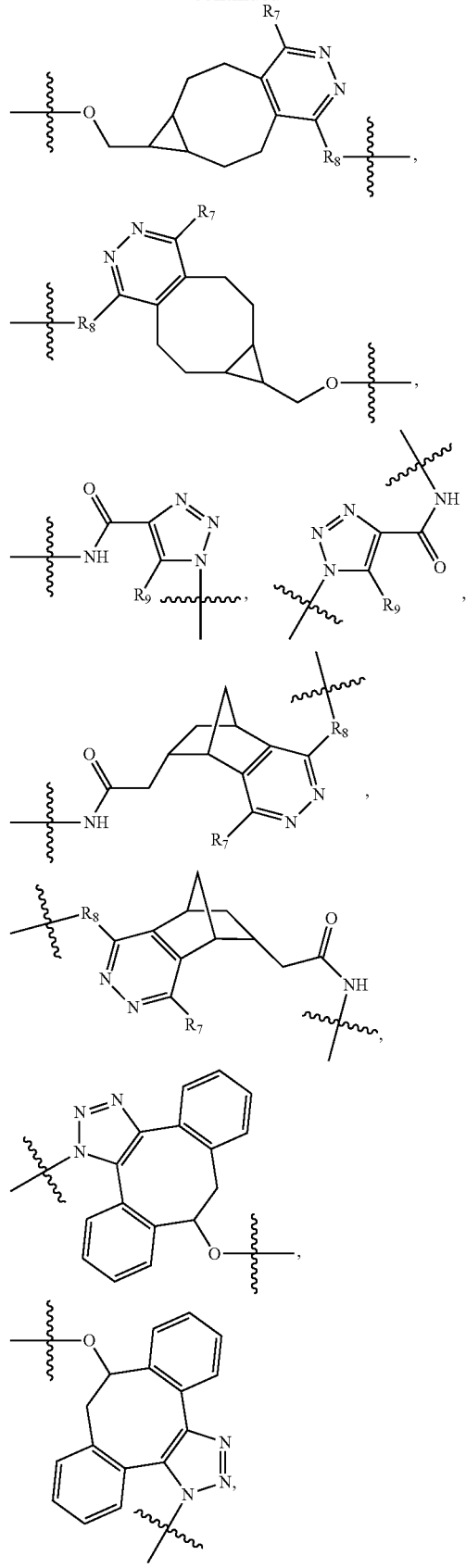

—S—, —Si(OH)$_2$O—,

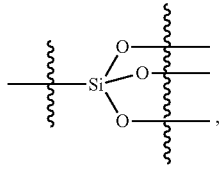

—CHR$^4$(CH$_2$)$_n$C(=O)NH—, —CHR$^4$(CH$_2$)$_n$NHC(=O)—, —C(=O)NH— and —NHC(=O)—;

each R$^4$ is independently selected from H, C$_{1-4}$alkyl, —C(=O)OH and —OH, each R$^5$ is independently selected from H, C$_{1-4}$alkyl, phenyl or C$_{1-4}$alkyl substituted with 1 to 3 —OH groups;

each R$^6$ is independently selected from H, fluoro, benzyloxy substituted with —C(=O)OH, benzyl substituted with —C(=O)OH, C$_{1-4}$alkoxy substituted with —C(=O)OH and C$_{1-4}$alkyl substituted with —C(=O)OH;

R$^7$ is independently selected from H, phenyl and pyridine;

R$^8$ is independently selected from

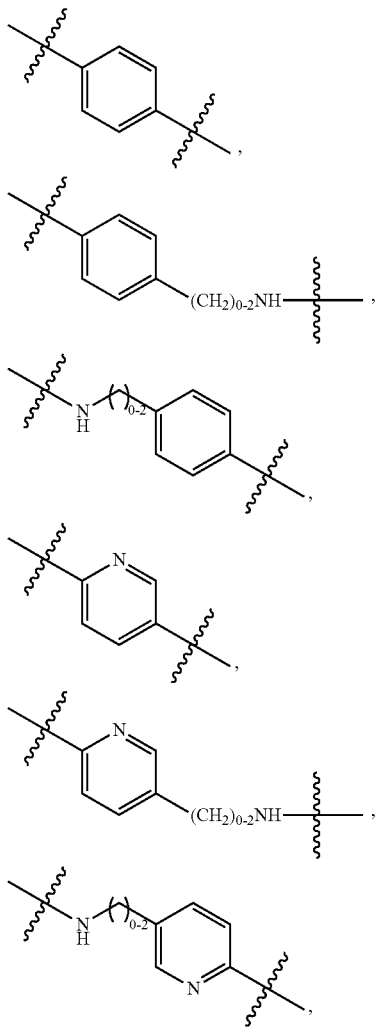

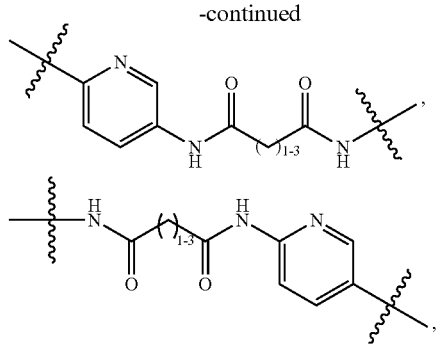

R$^9$ is independently selected from H and C$_{1-6}$haloalkyl;

each n is independently selected from 1, 2, 3, 4, 5, 6, 7, 8 and 9, and each m is independently selected from 1, 2, 3, 4, 5, 6, 7, 8 and 9.

In certain embodiments of any of the compounds or methods described herein, L$_1$ is —C(=O)—NH—CH$_2$—CH$_2$—S-[L$_2$-L$_3$-L$_4$-TG]. (Portions of these formulas depicted in brackets such as [L$_2$-L$_3$-L$_4$-TG] are added to the formula being described in order to identify which open valence of the formula is attached to the bracket-enclosed part of the remainder of the structure.)

In certain embodiments of any of the compounds or methods described herein, L$_2$ is selected from:

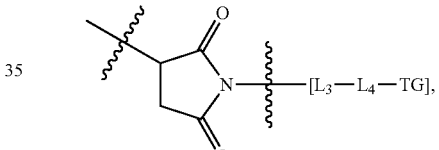

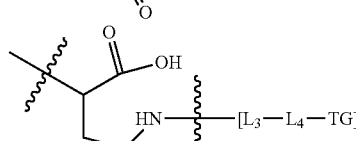

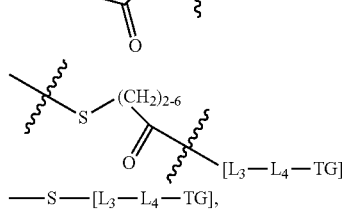

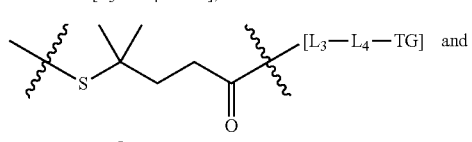

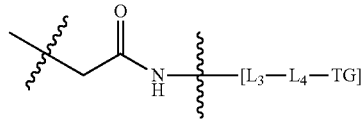

In certain embodiments of any of the compounds or methods described herein, L$_3$ is selected from —(CH$_2$)$_{2-6}$—C(=O)-[L$_4$-TG]; —(CH$_2$)$_{2-6}$—NH-[L$_4$-TG]; —(CH$_2$)$_{2-6}$—S-[L$_4$-TG]; —(CH$_2$)$_{2-6}$—Z-[L$_4$-TG]; and —(CH$_2$)$_{2-6}$—Z-C(=O)-[L$_4$-TG], where Z is O, NH or S.

In certain embodiments of any of the compounds or methods described herein, L₄ is a bond or a val-cit linker of this formula:

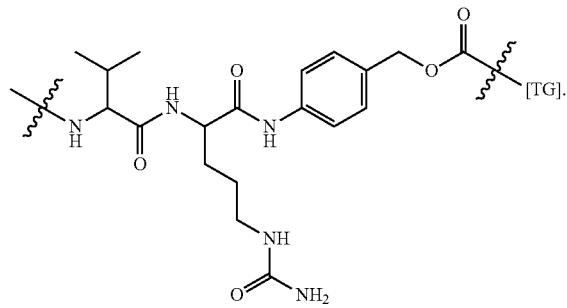

When L₄ is a val-cit linker, L₃ is preferably —(CH$_2$)$_{2-6}$—C(=O)—.

In certain embodiments of any of the compounds or methods described herein, TG is a maytansinoid such as DM1 or DM4, or a dolostatin 10 compound, e.g. auristatins MMAF or MMAE, or a calicheamicin such as N-acetyl-γ-calicheamicin, or a label or dye such as rhodamine or tetramethylrhodamine.

As used herein, a "linker" is any chemical moiety that is capable of linking an antibody or a fragment thereof to a terminal group. Linkers can be susceptible to cleavage, such as, acid-induced cleavage, light-induced cleavage, peptidase-induced cleavage, esterase-induced cleavage, and disulfide bond cleavage, at conditions under which the compound or the antibody remains active. Alternatively, linkers can be substantially resistant to cleavage. A linker may or may not include a self-immolative spacer.

Non-limiting examples of the non-enzymatically cleavable linkers as used herein to conjugate a terminal group (TG) to the modified antibodies or antigen binding fragment thereof provided herein include, acid-labile linkers, linkers containing a disulfide moiety, linkers containing a triazole moiety, linkers containing a hydrazine moiety, linkers containing a thioether moiety, linkers containing a diazo moiety, linkers containing an oxime moiety, linkers containing an amide moiety and linkers containing an acetamide moiety.

Non-limiting examples of the enzymatically cleavable linkers as used herein to conjugate a terminal group (TG) to the modified antibodies or antigen binding fragment thereof provided herein include, but are not limited to, linkers which are cleaved by a protease, linkers which are cleaved by an amidase, and linkers which are cleaved by β-glucuronidase.

In certain embodiments, such enzyme cleavable linkers are linkers which are cleaved by cathepsin, including cathepsin Z, cathepsin B, cathepsin H and cathepsin C. In certain embodiments the enzymatically cleavable linker is a dipeptide cleaved by cathepsin, including dipeptides cleaved by cathepsin Z, cathepsin B, cathepsin H or cathepsin C. In certain embodiments the enzymatically cleavable linker is a cathepsin B-cleavable peptide linker. In certain embodiments the enzymatically cleavable linker is a cathepsin B-cleavable dipeptide linker. In certain embodiments the enzymatically cleavable linker is a cathepsin B-cleavable dipeptide linker is valine-citrulline or phenylalanine-lysine. Other non-limiting examples of the enzymatically cleavable linkers as used herein conjugate a terminal group (TG) to the modified antibodies or antigen binding fragment thereof provided herein include, but are not limited to, linkers which are cleaved by β-glucuronidase, e.g.,

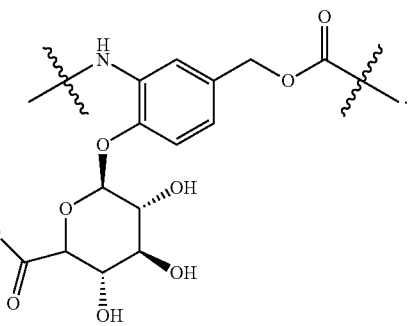

See Ducry et al, *Bioeonjugate Chem*, vol. 21(1), 5-13 (2010).

"Self-immolative spacers" are bifunctional chemical moieties covalently linked at one termini to a first chemical moiety and at the other termini to a second chemical moiety, thereby forming a stable tripartate molecule. Upon cleavage of a bond between the self-immolative spacer and the first chemical moiety, self-immolative spacers undergoing rapid and spontaneous intramolecular reactions and thereby separate from the second chemical moiety. These intramolecular reactions generally involve electronic rearrangements such as 1,4, or 1,6, or 1,8 elimination reactions or cyclizations to form highly favored five- or six-membered rings. In certain embodiments of the present invention, the first moiety is an enzyme cleavable linker and this cleavage results from an enzymatic reaction, while in other embodiments the first moiety is an acid labile linker and this cleavage occurs due to a change in pH. As applied to the present invention, the second moiety is the "Label" group as defined herein. In certain embodiments, cleavage of the first moiety from the self-immolative spacer results from cleavage by a proteolytic enzyme, while in other embodiments it results from cleaved by a hydrolase. In certain embodiments, cleavage of the first moiety from the self-immolative spacer results from cleavage by a cathepsin enzyme.

In certain embodiments, the enzyme cleavable linker is a peptide linker and the self-immolative spacer is covalently linked at one of its ends to the peptide linker and covalently linked at its other end to a drug moiety. This tripartite molecule is stable and pharmacologically inactive in the absence of an enzyme, but which is enzymatically cleavable by enzyme at the bond covalently linking the spacer moiety and the peptide moiety. The peptide moiety is cleaved from the tripartate molecule which initiates the self-immolating character of the spacer moiety, resulting in spontaneous cleavage of the bond covalently linking the spacer moiety to the drug moiety, to thereby effect release of the drug in pharmacologically active form.

Non-limiting examples of the self-immolative spacer optionally used in the conjugation of a terminal group (TG) to the modified antibodies or antigen binding fragment thereof provided herein include, but are not limited to, moieties which include a benzyl carbonyl moiety, a benzyl ether moiety, a 4-aminobutyrate moiety, a hemithioaminal moiety or a N-acylhemithioaminal moiety.

Other examples of self-immolative spacers include, but are not limited to, p-aminobenzyloxycarbonyl groups, aromatic compounds that are electronically similar to the p-aminobenzyloxycarbonyl group, such as 2-aminoimidazol-5-methanol derivatives and ortho or para-aminobenzylacetals. In certain embodiments, self-immolative spacers used herein which undergo cyclization upon amide bond hydrolysis, include substituted and unsubstituted 4-aminobutyric acid amides and 2-aminophenylpropionic acid amides.

In certain embodiments, the self-immolative spacer is

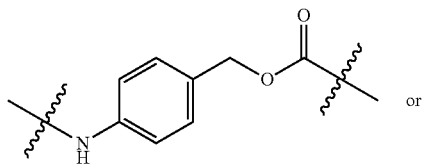

or

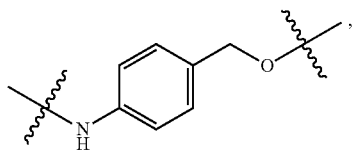

while in other embodiments the self-immolative spacer is

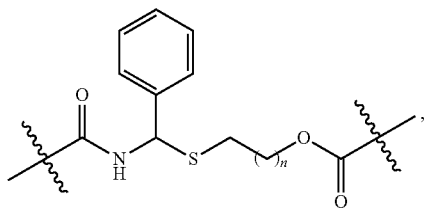

where n is 1 or 2. In other embodiments the self-immolative spacer is

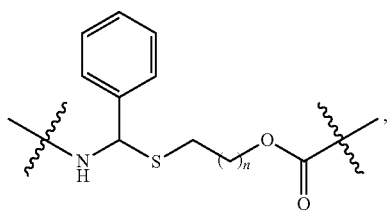

where n is 1 or 2. In other embodiments the self-immolative spacer is

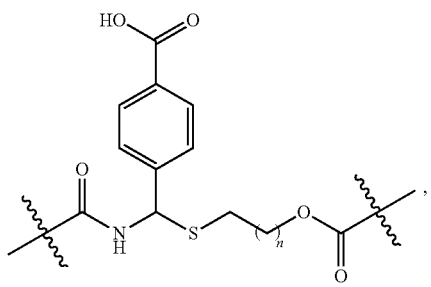

where n is 1 or 2. In other embodiments the self-immolative spacer is

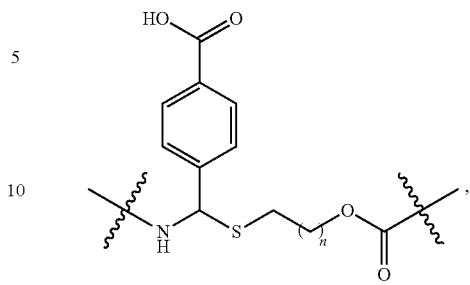

where n is 1 or 2. In other embodiments the self-immolative spacer is

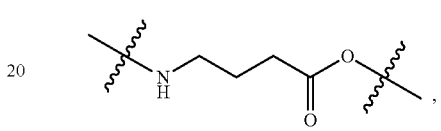

where n is 1 or 2.

Scheme (Ib) illustrates the post-translational modification of the modified antibodies or antigen binding fragment thereof provided herein wherein the Linker Unit (LU) is $-L_1-L_2-L_3-L_4-$.

Scheme (Ib)

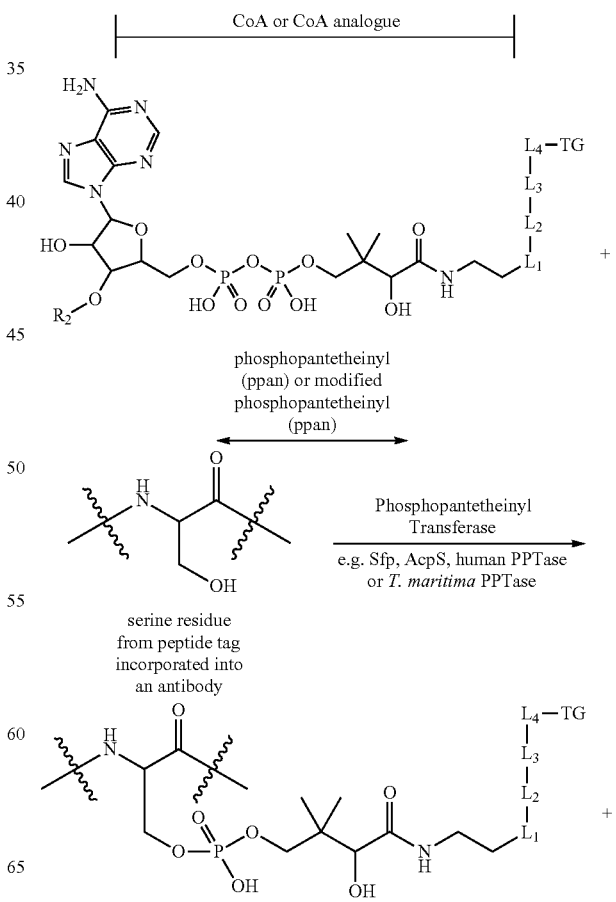

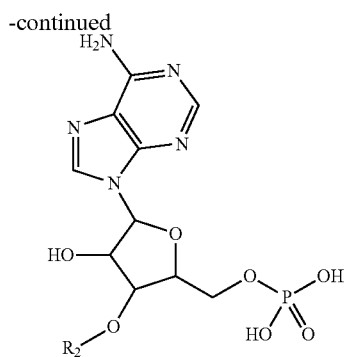

where $R_2$, $L_1$, $L_2$, $L_3$, $L_4$ and TG are as defined herein.

The CoA analogues of Scheme (Ia) and Scheme (Ib) may be obtained by total chemical synthesis, however the CoA analogues of Scheme (Ia) and Scheme (Ib) are preferably obtained by a chemoenzymatic process wherein pantetheine analogues are chemically synthesized and then biosynthetically converted into the corresponding CoA analogue (see Kristine M. Clarke et al., "in Vivo Reporter Labeling of Proteins via Metabolic Delivery of Coenzyme A Analogues", J. Am. Chem. Soc., 2005, 127, p. 11234-11235 and Jordan L. Meier et al., "Synthesis and Evaluation of Bioorthogonal Pantetheine Analogues for in Vivo Protein Modification", J. Am. Chem. Soc., 2006, 128, p. 12174-12184). The biosynthetic conversion for CoA analogues of Scheme (Ia) is shown below:

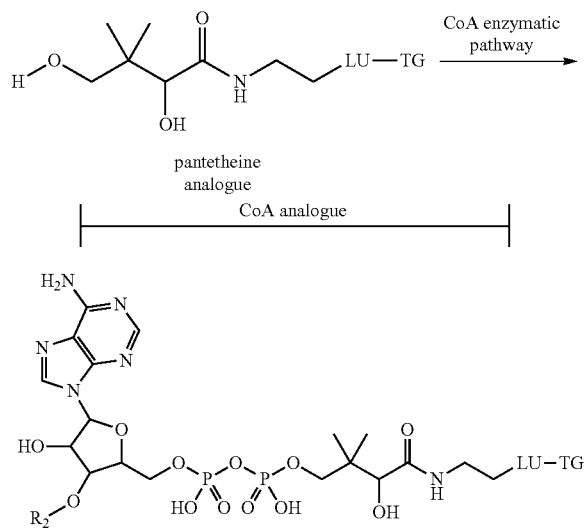

while the biosynthetic conversion for CoA analogues of Scheme (Ib) is shown below:

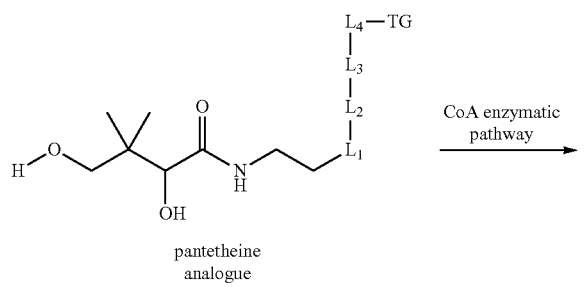

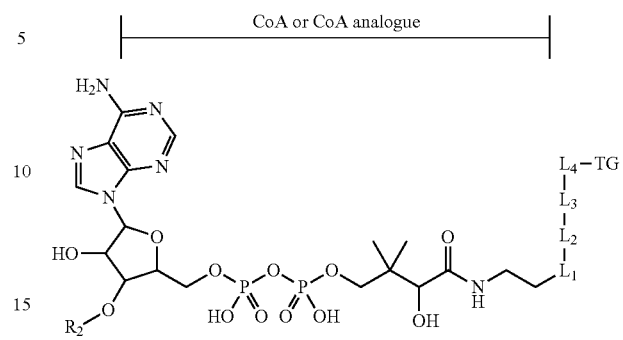

where LU, $L_1$, $L_2$, $L_3$, $L_4$ and TG are as defined herein.

In certain embodiments the biosynthetic conversion occurs "in-vivo", wherein the pantetheine analogue enters a cell from the surrounding media whereby once inside the cell it is converted by the CoA enzymatic pathway into the corresponding CoA analogue. In a specific embodiment, E. coli is used for the biosynthetic conversion of pantetheine analogues into the corresponding CoA analogues, wherein the pantetheine analogue enters E. coli from the surrounding media and once inside the cell the pantetheine analogue is initially phosphorylated by the pantothenate kinase (PanK or CoaA) using adenosine-5'-triphosphate (ATP), then adenylated by the phosphopantetheine adenylyltransferase (PPAT or CoaD) to give the dephospho-CoA analogue and then further phosphorylated by the dephosphocoenzyme A kinase (DPCK or CoaE) to yield the CoA analogue.

In other embodiments the biosynthetic conversion occurs "in-vitro", wherein the enzymatic CoA pathway is reconstituted with the pantetheine analogue, whereby it is converted "in-vitro" by the reconstituted CoA enzymatic pathway into the corresponding CoA analogue. In a specific embodiment of "in-vitro" conversion, the reconstituted CoA enzymatic pathway is the E. coli CoA enzymatic pathway, wherein the pantetheine analogue is initially phosphorylated by CoaA and ATP, then adenylated by CoaD to give the dephospho-CoA analogue and then further phosphorylated by CoaE to yield the CoA analogue.

In certain embodiments the Linker Unit (LU) is —C(=O)NH(CH$_2$)$_2$S-L$_2$-L$_3$-L$_4$- and R$_2$ is —P(=O)(OH)$_2$, and in such an embodiment the terminal group is linked to CoA. Scheme (Ic) illustrates the post-translational modification of the modified antibodies or antigen binding fragment thereof provided herein for the specific embodiment wherein the PPTase catalyzes the reaction between the conserved serine residue in the incorporated short peptide tag and a terminal group (TG) linked to coenzyme A (CoA):

Scheme (Ic)

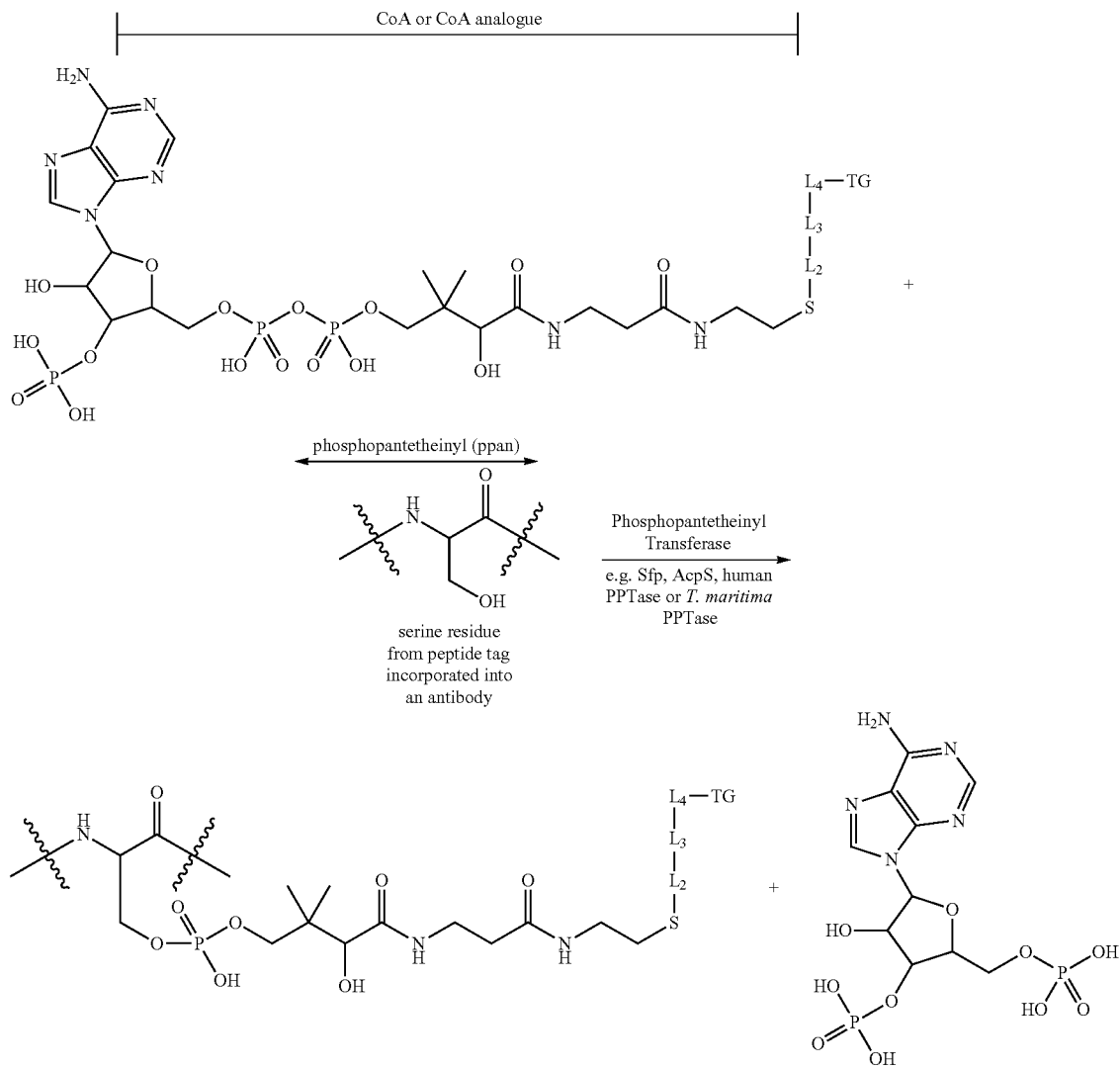

where $L_2$, $L_3$, $L_4$ and TG are as defined herein

In certain embodiments, the modified antibodies or antigen binding fragment thereof provided herein are site-specifically labeled by a one-step method as shown in Scheme (Ia), Scheme (Ib) and Scheme (Ic), wherein a terminal group linked to CoA or a CoA analogue reacts with the conserved serine of the short peptide tag engineered into the antibody.

The one step method includes the steps of:
(a) providing a modified antibody or antigen binding fragment thereof which has been engineered to contain a small peptide tag, and wherein the peptide tag is a substrate of an enzyme having 4'-phosphopantetheinyl transferase activity, and
(b) labeling the modified antibody or antigen binding fragment thereof with a terminal group by incubating the modified antibody or antigen binding fragment thereof with an enzyme having 4'-phosphopantetheinyl transferase activity in the presence of a compound having the structure of Formula (A):

Formula (A)

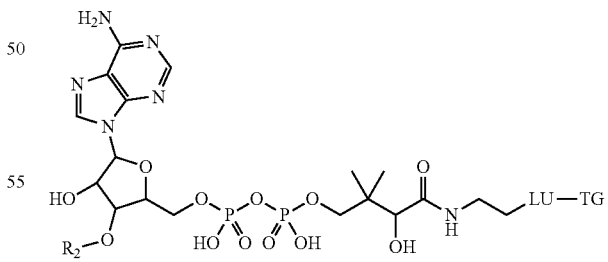

wherein:
$R_2$, Linker Unit (LU) and TG are as described herein.

In such One-Step methods using a compound of Formula (A) the terminal group (TG) is thereby conjugated to the modified antibody or antigen binding fragment thereof via a linker having the structure according to Formula (I-a). The linker of Formula (I-a) is attached to the small peptide tag by a phosphodiester bond formed between the 4'-phosphopantetheinyl moiety and the hydroxyl group of the conserved serine residue of the short peptide tag engineered into the antibody:

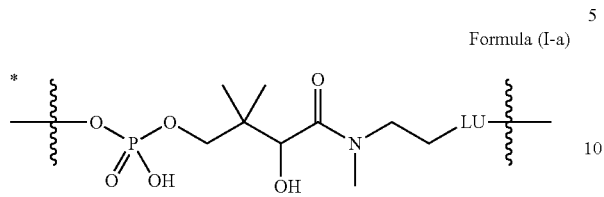

Formula (I-a)

where LU is as defined herein and the * denotes that the 4'-phosphopantetheinyl moiety is attached to the small peptide tag.

In certain embodiments, the one step method includes the steps of:
(a) providing a modified antibody or antigen binding fragment thereof which has been engineered to contain a small peptide tag, and wherein the peptide tag is a substrate of an enzyme having 4'-phosphopantetheinyl transferase activity, and
(b) labeling the modified antibody or antigen binding fragment thereof with a terminal group by incubating the modified antibody or antigen binding fragment thereof with an enzyme having 4'-phosphopantetheinyl transferase activity in the presence of a compound having the structure of Formula (B):

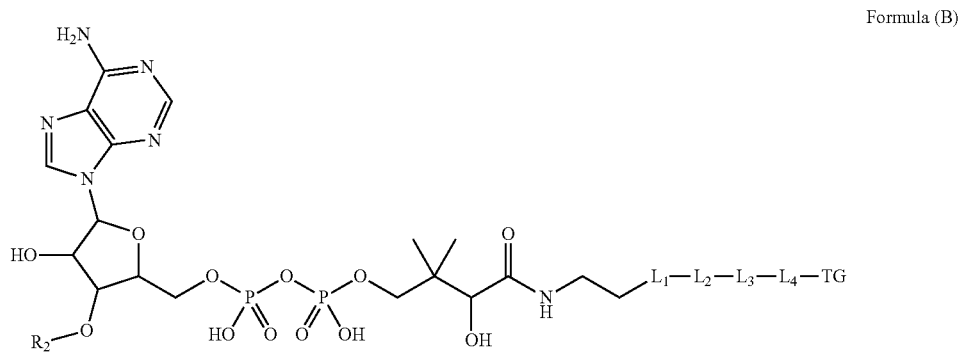

Formula (B)

where $R_2$, $L_1$, $L_2$, $L_3$, $L_4$ and TG are as defined herein.

In such One-Step methods using a compound of Formula (B) described above the terminal group is thereby attached to the modified antibody or antigen binding fragment thereof via a linker having the structure according to Formula (I-b). The linker of Formula (I-b) is attached to the small peptide tag by a phosphodiester bond formed between the 4'-phosphopantetheinyl moiety and the hydroxyl group of the conserved serine residue of the short peptide tag engineered into the antibody:

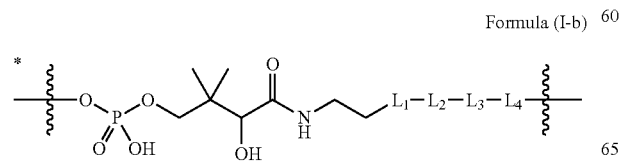

Formula (I-b)

where $L_1$, $L_2$, $L_3$ and $L_4$ are as defined herein and the * denotes that the 4'-phosphopantetheinyl moiety is attached to the small peptide tag.

In other embodiments, the one step method includes the steps of:

(a) providing a modified antibody or antigen binding fragment thereof which has been engineered to contain a small peptide tag, and wherein the peptide tag is a substrate of an enzyme having 4'-phosphopantetheinyl transferase activity, and
(b) labeling the modified antibody or antigen binding fragment thereof with a terminal group by incubating the modified antibody or antigen binding fragment thereof with an enzyme having 4'-phosphopantetheinyl transferase activity in the presence of a compound having the structure of Formula (C):

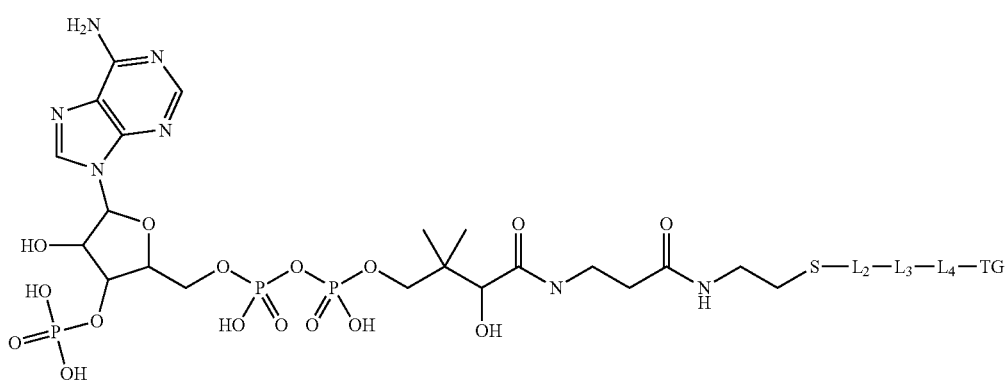

Formula (C)

where $L_2$, $L_3$, $L_4$ and TG are as defined herein.

In such One-Step methods using a compound of Formula (C) described above the terminal group is thereby attached to the modified antibody or antigen binding fragment thereof via a linker having the structure according to Formula (I-c). The linker of Formula (I-c) is attached to the small peptide tag by a phosphodiester bond formed between the 4'-phosphopantetheinyl moiety and the hydroxyl group of the conserved serine residue of the short peptide tag engineered into the antibody:

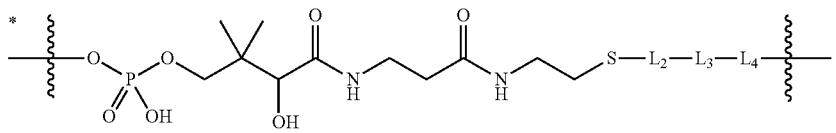

Formula (I-c)

where $L_2$, $L_3$ and $L_4$ are as defined herein and the * denotes that the 4'-phosphopantetheinyl moiety is attached to the small peptide tag.

In certain embodiments of the One-Step Methods described herein, the modified antibody or antigen binding fragment thereof is contacted with a compound having the structure of Formula (A), Formula (B) or Formula (C) and a 4'-phosphopantetheinyl transferase enzyme that is co-expressed in the same cell as the expressed modified antibody or antigen binding fragment thereof. In certain embodiments of the One-Step Methods described herein, the modified antibody or antigen binding fragment thereof is contacted in the cell culture media with a compound having the structure of Formula (A), Formula (B) or Formula (C) and 4'-phosphopantetheinyl transferase enzyme produced in the same or in another cell. In certain embodiments of the One-Step Methods described herein, the 4'-phosphopantetheinyl transferase enzyme is immobilized on solid support. In certain embodiments the solid support is optionally comprised of a polymer on a bead or a column.

In certain embodiments of methods, compounds and immunoconjugates provided herein: $L_1$ is $-A_1X^2-$, $L_2$ is a bond, $L_3$ is a bond, $L_4$ is $-A_4-$, $A_1$ is $-C(=O)NH(CH_2)_nS-$, $A_4$ is $-(CH_2)_nNHC(=O)-$, and $X^2$ is

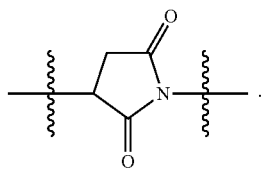 [SMILES: *C1CC(=O)N(*)C1=O]

In certain embodiments of methods, compounds and immunoconjugates provided herein: $L_1$ is $-A_1X^2-$, $L_2$ is a bond, $L_3$ is a bond, $L_4$ is $-A_4-$, $A_1$ is $-C(=O)NH(CH_2)_nS-$, $A_4$ is $-(CH_2)_nNHC(=O)-$; $X^2$ is

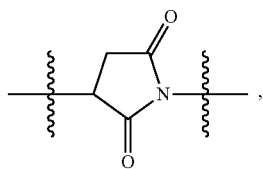 [SMILES: *C1CC(=O)N(*)C1=O]

and TG is a fluorescent probe.

In certain embodiments of the compound of Formula (B) is

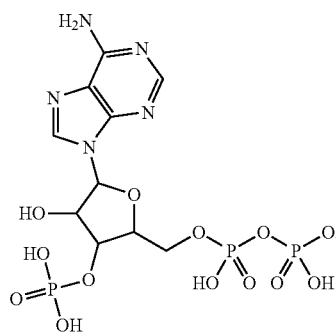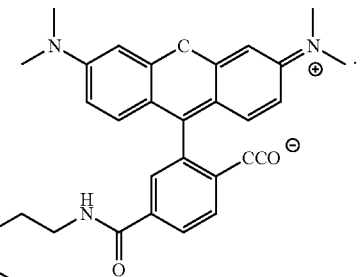

In certain embodiments of methods, compounds and immunoconjugates provided herein: $L_1$ is $-A_1X^2-$, $L_2$ is a bond, $L_3$ is a bond, $L_4$ is $-A_4-$, $A_1$ is $-C(=O)NH(CH_2)_nS-$, $A_4$ is $-(CH_2)_nC(=O)-$, and $X^2$ is

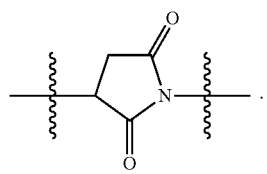 [SMILES: *C1CC(=O)N(*)C1=O]

In certain embodiments of methods, compounds and immunoconjugates provided herein: $L_1$ is $-A_1X^2-$, $L_2$ is a bond, $L_3$ is a bond, $L_4$ is $-A_4-$, $A_1$ is $-C(=O)NH(CH_2)_nS-$, $A_4$ is $-(CH_2)_nC(=O)-$; $X^2$ is

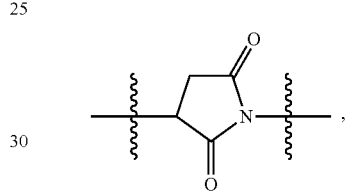

and TG is a drug moiety.

In certain embodiments the compound of Formula (B) is

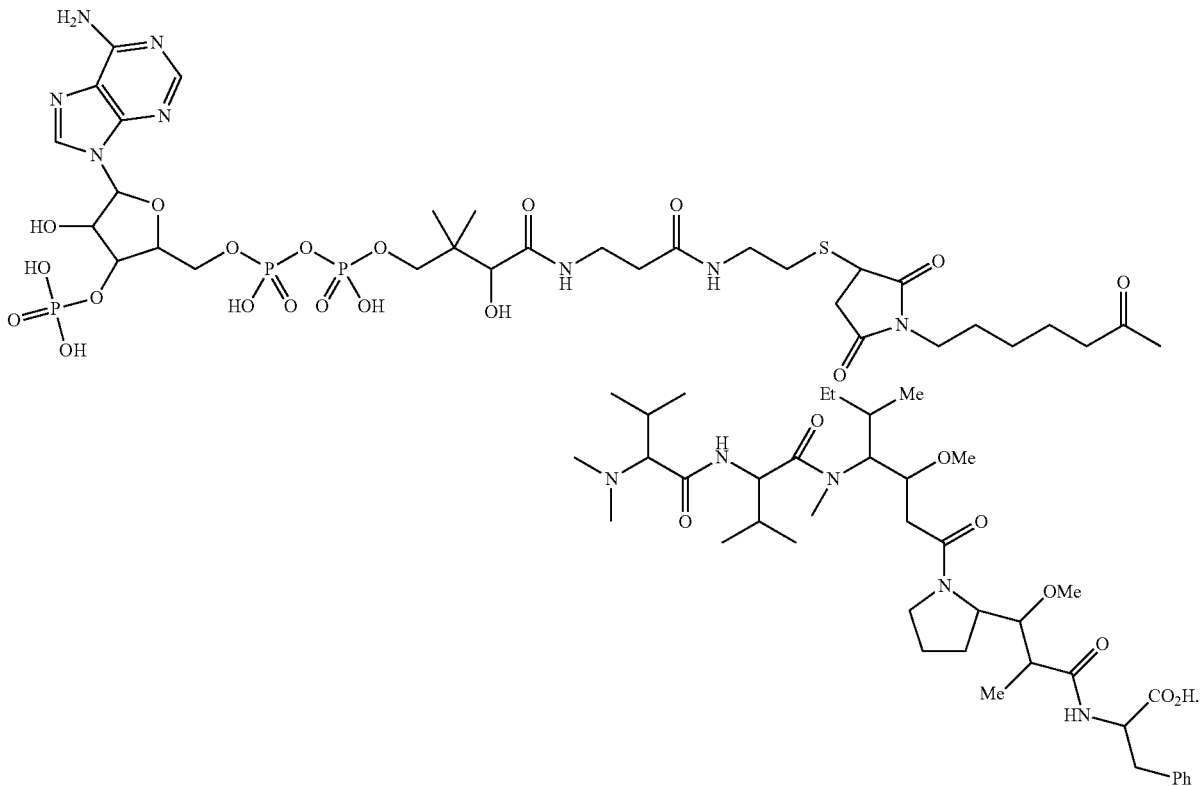

In certain embodiments of methods, compounds and immunoconjugates provided herein: $L_1$ is $-A_1X^2-$, $L_2$ is $-A_2-$, $L_3$ is $-A_3-$, $L_4$ is

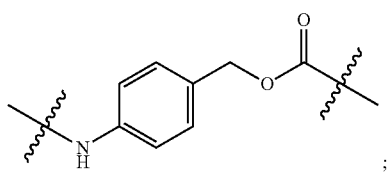 [SMILES: *Nc1ccc(COC(*)=O)cc1]

;

$A_1$ is $-C(=O)NH(CH_2)_nS-$, $A_2$ is $-(CH_2)_nC(=O)$, $A_3$ is

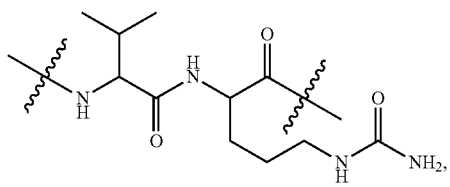 [SMILES: *NC(C(=O)NC(CCCNC(N)=O)C(*)=O)C(C)C]

and $X^2$ is

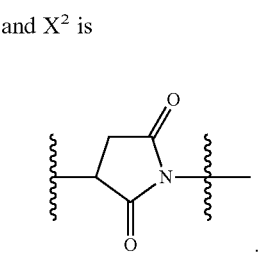

.

In certain embodiments of methods, compounds and immunoconjugates provided herein: $L_1$ is $-A_1X^2-$, $L_2$ is $-A_2-$, $L_3$ is $-A_3-$, $L_4$ is

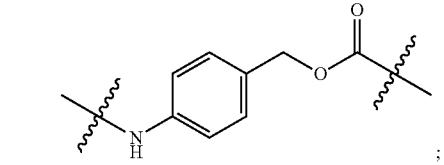 [SMILES: *Nc1ccc(COC(*)=O)cc1]

;

$A_1$ is $-C(=O)NH(CH_2)_nS-$, $A_2$ is $-(CH_2)_nC(=O)$, $A_3$ is

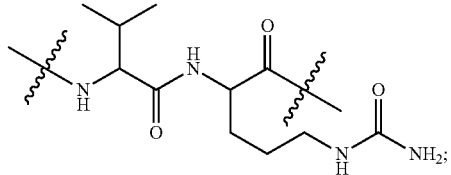 [SMILES: *NC(C(=O)NC(CCCNC(N)=O)C(*)=O)C(C)C]

;

$X^2$ is

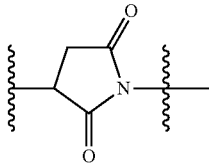

, and TG is a drug moiety.

In certain embodiments the compound of Formula (B) is

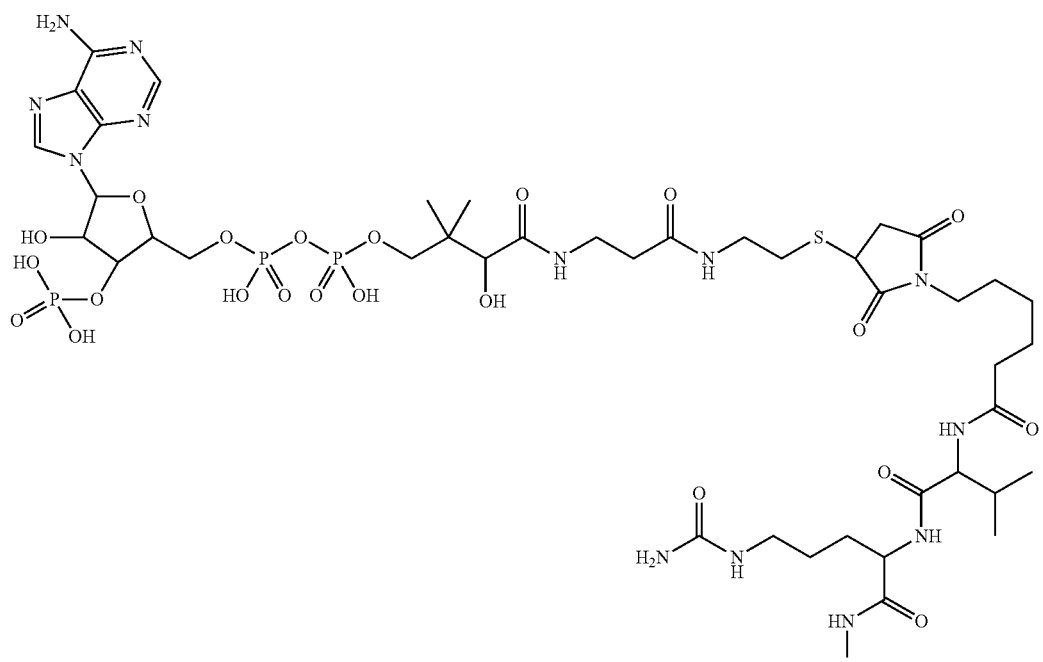

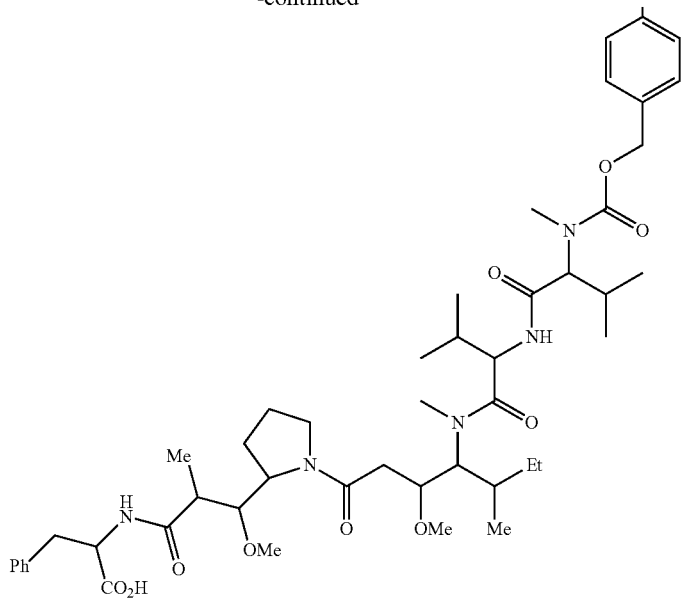

In certain embodiments of methods, compounds and immunoconjugates provided herein: $L_1$ is a -$A_1X^2$—, $L_2$ is a bond-, $L_3$ is -$A_3$-, $L_4$ is a bond, $A_1$ is —C(=O)NH$(CH_2)_nS$—, $A_3$ is —$(CH_2)_nC$(=O)—, and $X^2$ is —$(CH_2)_nC$(=O)NH—.

In certain embodiments of methods, compounds and immunoconjugates provided herein: $L_1$ is a -$A_1X^2$—, $L_2$ is a bond-, $L_3$ is -$A_3$-, $L_4$ is a bond, $A_1$ is —C(=O)NH$(CH_2)_nS$—, $A_3$ is —$(CH_2)_nC$(=O)—, $X^2$ is —$(CH_2)_nC$(=O)NH—, and TG is a drug moiety.

In certain embodiments the compound of Formula (B) is

In certain embodiments of methods, compounds and immunoconjugates provided herein: $L_1$ is a -$A_1X^2$—, $L_2$ is a bond, $L_3$ is -$A_3$-, $L_4$ is a bond, $A_1$ is —C(=O)NH$(CH_2)_nS$, $A_3$ is —$(CH_2)_nC$(=O)—, $X^2$ is —$CHR^4(CH_2)_nC$(=O)NH—, and $R^4$ is —C(=O)OH.

In certain embodiments of methods, compounds and immunoconjugates provided herein: $L_1$ is a -$A_1X^2$—, $L_2$ is a bond, $L_3$ is -$A_3$-, $L_4$ is a bond, $A_1$ is —C(=O)NH$(CH_2)_nS$, $A_3$ is —$(CH_2)_nC$(=O)—, $X^2$ is —$CHR^4(CH_2)_nC$(=O)NH—, $R^4$ is —C(=O)OH, and TG is a drug moiety.

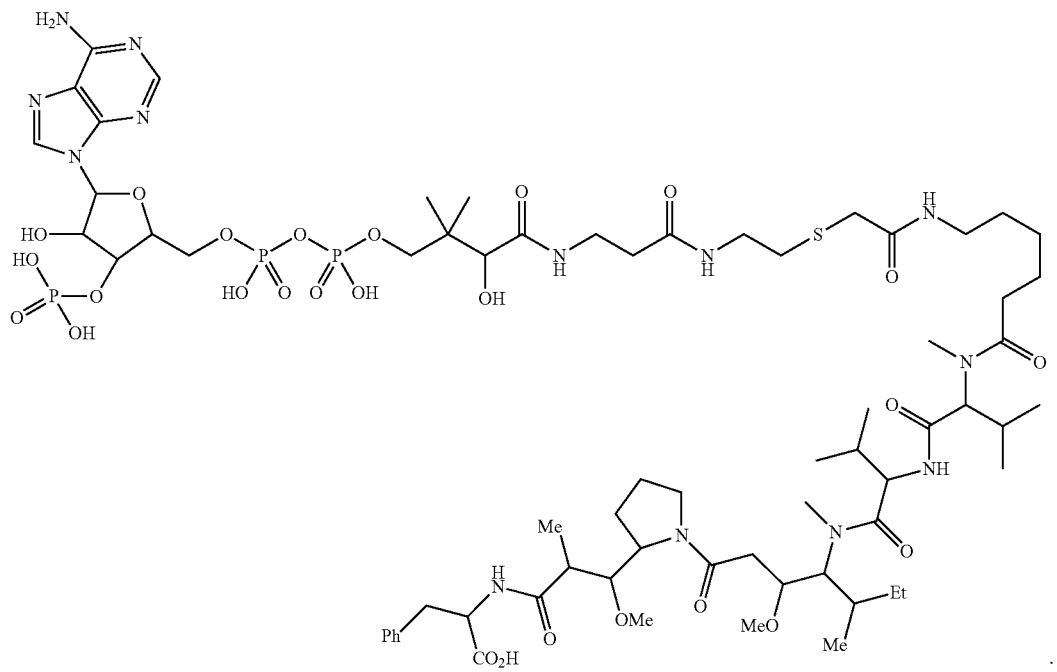 [SMILES: CCC(C)C(C(CC(=O)N1CCCC1C(OC)C(C)C(=O)NC(Cc1ccccc1)C(=O)O)OC)N(C)C(=O)C(NC(=O)C(C(C)C)N(C)C(=O)CCCCCNC(=O)CSCCNC(=O)CCNC(=O)C(O)C(C)(C)COP(=O)(O)OP(=O)(O)OCC1OC(n2cnc3c(N)ncnc32)C(O)C1OP(=O)(O)O)C(C)C]

In certain embodiments the compound of Formula (B) is

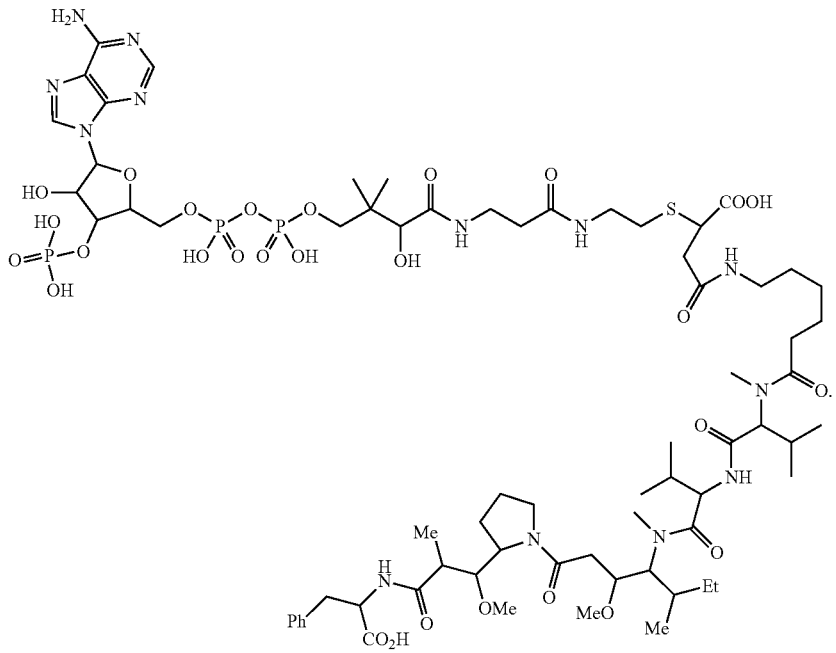 [SMILES: CCC(C)C(C(CC(=O)N1CCCC1C(OC)C(C)C(=O)NC(Cc1ccccc1)C(=O)O)OC)N(C)C(=O)C(NC(=O)C(C(C)C)N(C)C(=O)CCCCCNC(=O)CC(SCCNC(=O)CCNC(=O)C(O)C(C)(C)COP(=O)(O)OP(=O)(O)OCC1OC(n2cnc3c(N)ncnc32)C(O)C1OP(=O)(O)O)C(=O)O)C(C)C]

In certain embodiments of methods, compounds and immunoconjugates provided herein: $L_1$ is -$A_1X^2$—, where $A_1$ is —C(=O)NH(CH$_2$)$_n$S— and $X^2$ is —(CH$_2$)C(=O)NH—; $L_2$ is a bond; $L_3$ is a bond, and $L_4$ is -$A_4$- wherein $A_4$ is —(CH$_2$)$_n$NHC(=O)—.

In certain embodiments of methods, compounds and immunoconjugates provided herein: $L_1$ is -$A_1X^2$—, wherein $A_1$ is —C(=O)NH(CH$_2$)$_n$S— and $X^2$ is —(CH$_2$)C(=O)NH—; $L_2$ is a bond; $L_3$ is a bond; $L_4$ is -$A_4$-, wherein $A_4$ is —(CH$_2$)$_n$C(=O)—.

In certain embodiments of methods, compounds and immunoconjugates provided herein: $L_1$ is -$A_1X^2$—, wherein $A_1$ is —C(=O)NH(CH$_2$)$_n$S— and $X^2$ is —(CH$_2$)C(=O)NH—; $L_2$ is -$A_2$-, wherein $A_2$ is —(CH$_2$)$_n$C(=O; $L_3$ is -$A_3$-, wherein $A_3$ is

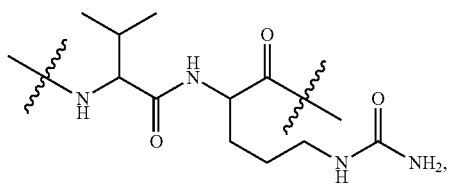 [SMILES: *NC(C(=O)NC(CCCNC(N)=O)C(*)=O)C(C)C]

and $L_4$ is

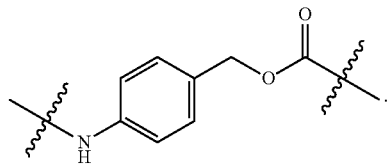 [SMILES: *Nc1ccc(COC(*)=O)cc1]

In certain embodiments of methods, compounds and immunoconjugates provided herein: $L_1$ is a -$A_1X^2$—, wherein $A_1$ is —C(=O)NH(CH$_2$)$_n$S— and $X^2$ is —(CH$_2$)C(=O)NH—; $L_2$ is a bond-; $L_3$ is -$A_3$-, wherein $A_3$ is —(CH$_2$)$_n$C(=O)—, and $L_4$ is a bond.

Two-Step Method

Alternatively, the modified antibodies or antigen binding fragment thereof provided herein are site-specifically labeled by a two-step method, wherein, in the first step the ppan prosthetic group of CoA, or modified ppan prosthetic group of the CoA analogue, which contain a functional group ($R_1$), is attached to the short peptide tag by a phosphodiester bond formed between the 4'-phosphopantetheinyl moiety and the hydroxyl group of the conserved serine residue of the short peptide tag which has been incorporated into the antibody. In the second step a terminal group (TG) linked, or directly attached to, a group which is reactive with the functional group ($R_1$) is reacted with the functional group ($R_1$) on the ppan prosthetic group of CoA, or on the modified ppan prosthetic group of the CoA analogue, thereby directly attaching the terminal group to the modified antibody or antigen binding fragment thereof or attaching the terminal group to the modified antibody or antigen binding fragment thereof via a Linker Unit (LU).

One embodiment of the Two-Step Method is shown in Scheme (IIa).

Scheme (IIa)

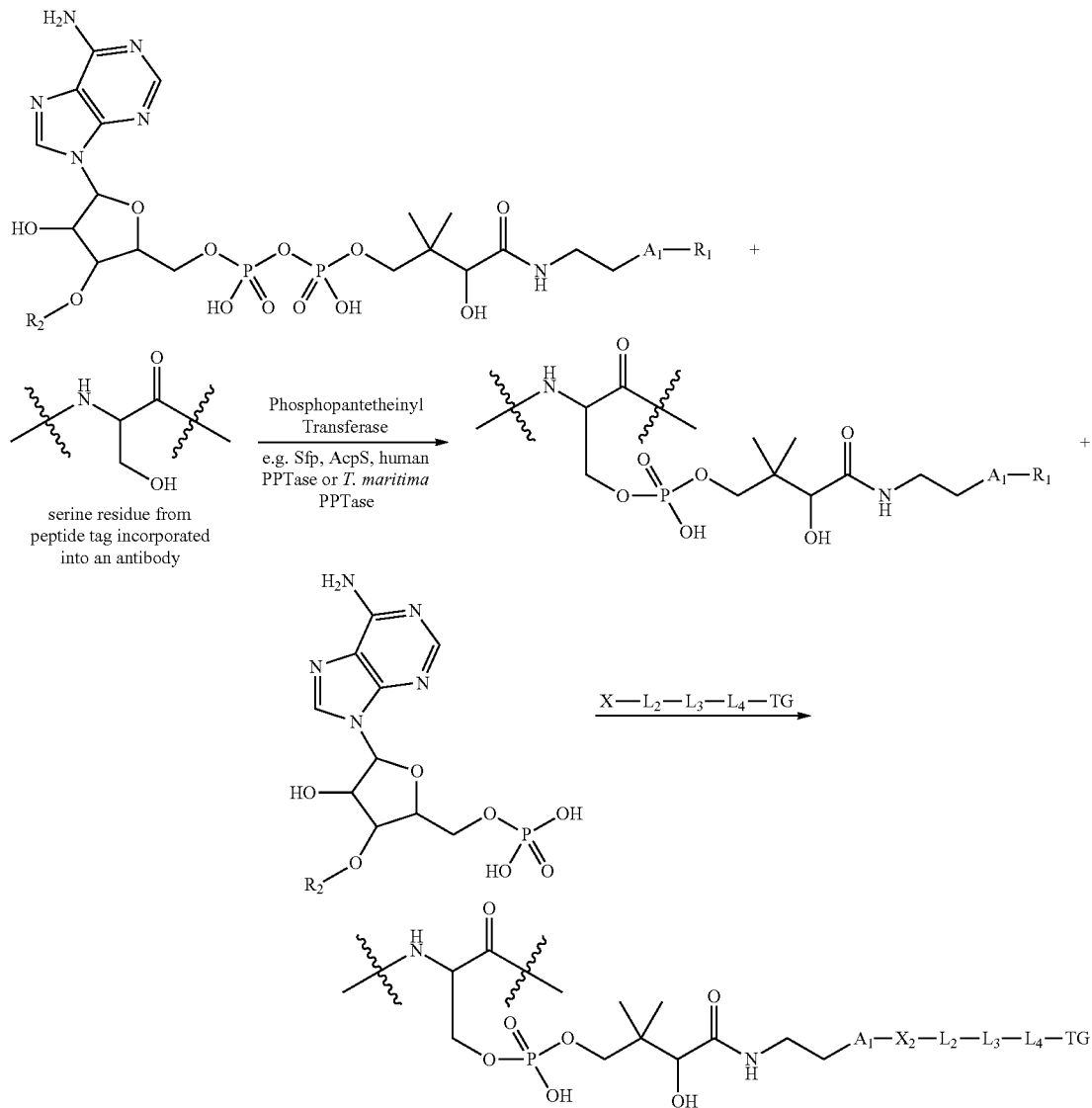

wherein X and a corresponding $R_1$ are as given below in Table 3, and where $R_2$, $A_1$, $L_2$, $X_2$, $L_3$, $L_4$ and TG are as defined herein:

TABLE 3

| X | $R_1$ |
|---|---|
| a thiol | a thiol, a maleimide or a haloacetamide |
| an azide | an alkyne, a triaryl phosphine, a cyclooctene or an oxanobornadiene |
| a triaryl phosphine | an azide |
| an oxanobornadiene | an azide |
| an alkyne | an azide |
| an alkene | an azide |
| a cyclooctene | a diaryl tetrazine |
| a diaryl tetrazine | a cyclooctene |
| a monoaryl tetrazine | a norbornene |
| a norbornene | a monoaryl tetrazine |
| an aldehyde | a hydroxylamine or a hydrazine or $NH_2$—NH—C(=O)— |

TABLE 3-continued

| X | $R_1$ |
|---|---|
| a ketone | a hydroxylamine or a hydrazine or $NH_2$—NH—C(=O)— |
| a hydroxylamine | an aldehyde or a ketone |
| a hydrazine | an aldehyde or a ketone |
| $NH_2$—NH—C(=O)— | an aldehyde or a ketone |
| a haloacetamide | a thiol |
| a maleimide | a thiol |

The alkene, alkyne, triaryl phosphine, cyclooctene, oxanobornadiene, diaryl tetrazine, monoaryl tetrazine and norbornene of X and $R_1$ are optionally substituted.

The Two-Step Method of Scheme (IIa) includes the steps of:
(a) providing a modified antibody or antigen binding fragment thereof which has been engineered to contain a peptide tag, and wherein the peptide tag is a substrate of an enzyme having 4'-phosphopantetheinyl transferase activity;

(b) labeling the modified antibody or antigen binding fragment thereof by:
incubating the modified antibody or antigen binding fragment thereof with an enzyme having 4'-phosphopantetheinyl transferase activity in the presence of a compound of Formula (D), Formula (D)

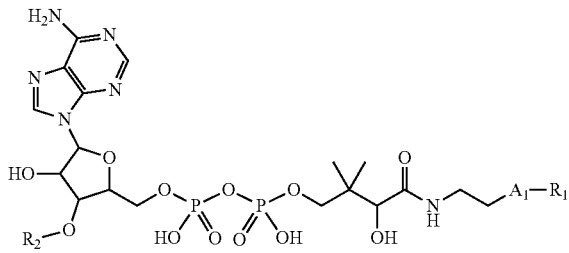

thereby attaching an activated 4'-phosphopantetheinyl group of Formula (D-a) to the peptide tag;

Formula (D-a)

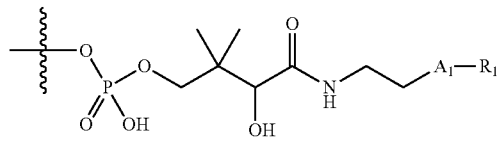

and (c) reacting the activated 4'-phosphopantetheinyl group with a compound of Formula (IIa):

$$X\text{-}L_2\text{-}L_3\text{-}L_4\text{-}TG \qquad \text{Formula (II-a),}$$

where X, $R_1$, $R_2$, $A_1$, $L_2$, $L_3$, $L_4$ and TG are as defined herein.

As a result of the Two-Step Method of Scheme (IIa) the Terminal group is attached to the modified antibody or antigen binding fragment thereof via a linker having the structure according to Formula (IIb):

Formula (II-b)

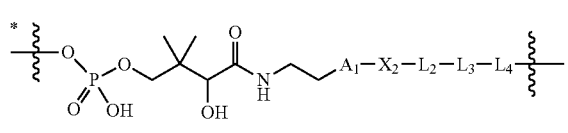

where $A_1$, $X_2$, $L_2$, $L_3$ and $L_4$ are as defined herein and the * denotes that the modified 4'-phosphopantetheinyl moiety is attached to the small peptide tag.

Another embodiment of the Two-Step Method is shown in Scheme (IIb).

Scheme (IIb)

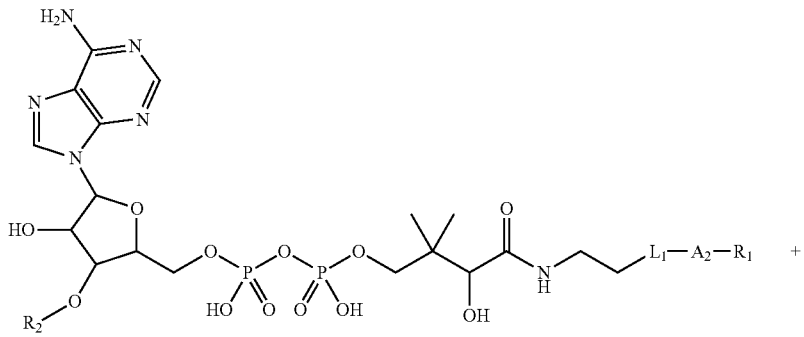

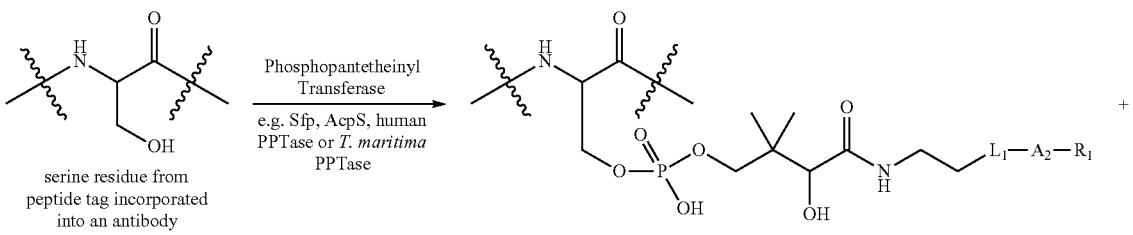

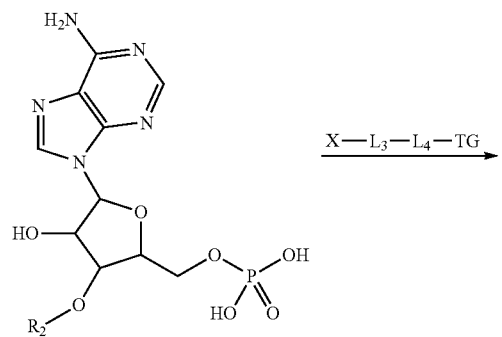

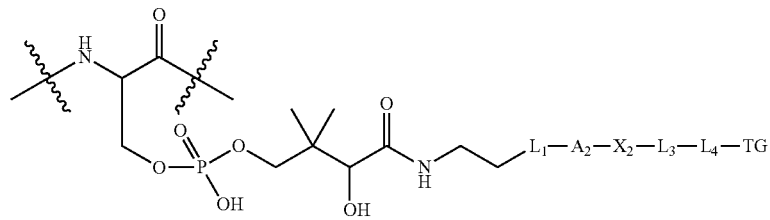

where X, $R_1$, $R_2$, $L_1$, $A_2$, $X_2$, $L_3$, $L_4$ and TG are as defined herein.

The Two-Step Method of Scheme (IIb) includes the steps of:
(a) providing a modified antibody or antigen binding fragment thereof which has been engineered to contain a short peptide tag, and wherein the peptide tag is a substrate of an enzyme having 4'-phosphopantetheinyl transferase activity;
(b) labeling the modified antibody or antigen binding fragment thereof by:
incubating the modified antibody or antigen binding fragment thereof with an enzyme having 4'-phosphopantetheinyl transferase activity in the presence of a compound of Formula (E), thereby attaching an activated 4'-phosphopantetheinyl group of Formula (E-a) to the short peptide tag;

Formula (E-a)

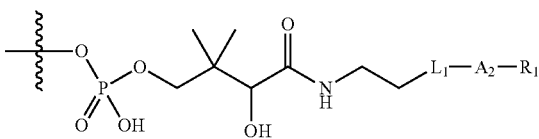

Formula (E)

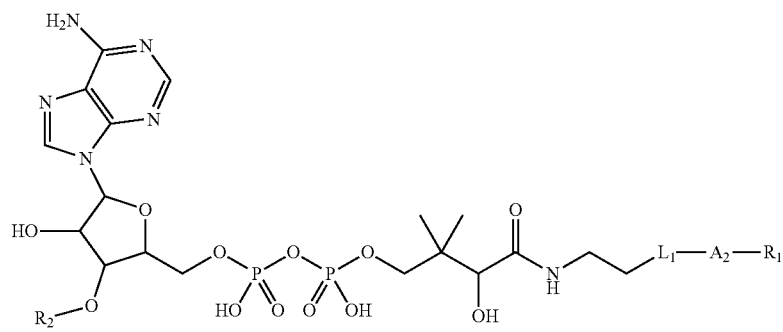

and (c) reacting the activated 4'-phosphopantetheinyl group with a compound of Formula (II-c):

X-L$_3$-L$_4$-TG     Formula (II-c), where X, R$_1$, R$_2$, L$_1$, A$_2$, L$_3$, L$_4$ and TG are as defined herein.

As a result of the Two-Step Method of Scheme (IIb) the terminal group is attached to the modified antibody or antigen binding fragment thereof via a linker having the structure according to Formula (II-d):

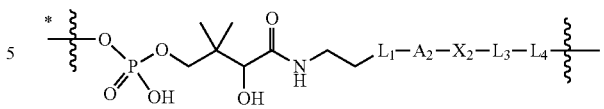

Formula (II-d)

where L$_1$, A$_2$, X$_2$, L$_3$ and L$_4$ are as defined herein and the * denotes that the modified 4'-phosphopantetheinyl moiety is attached to the small peptide tag.

Another embodiment of the Two-Step Method is shown in Scheme (II-c).

Scheme (IIc)

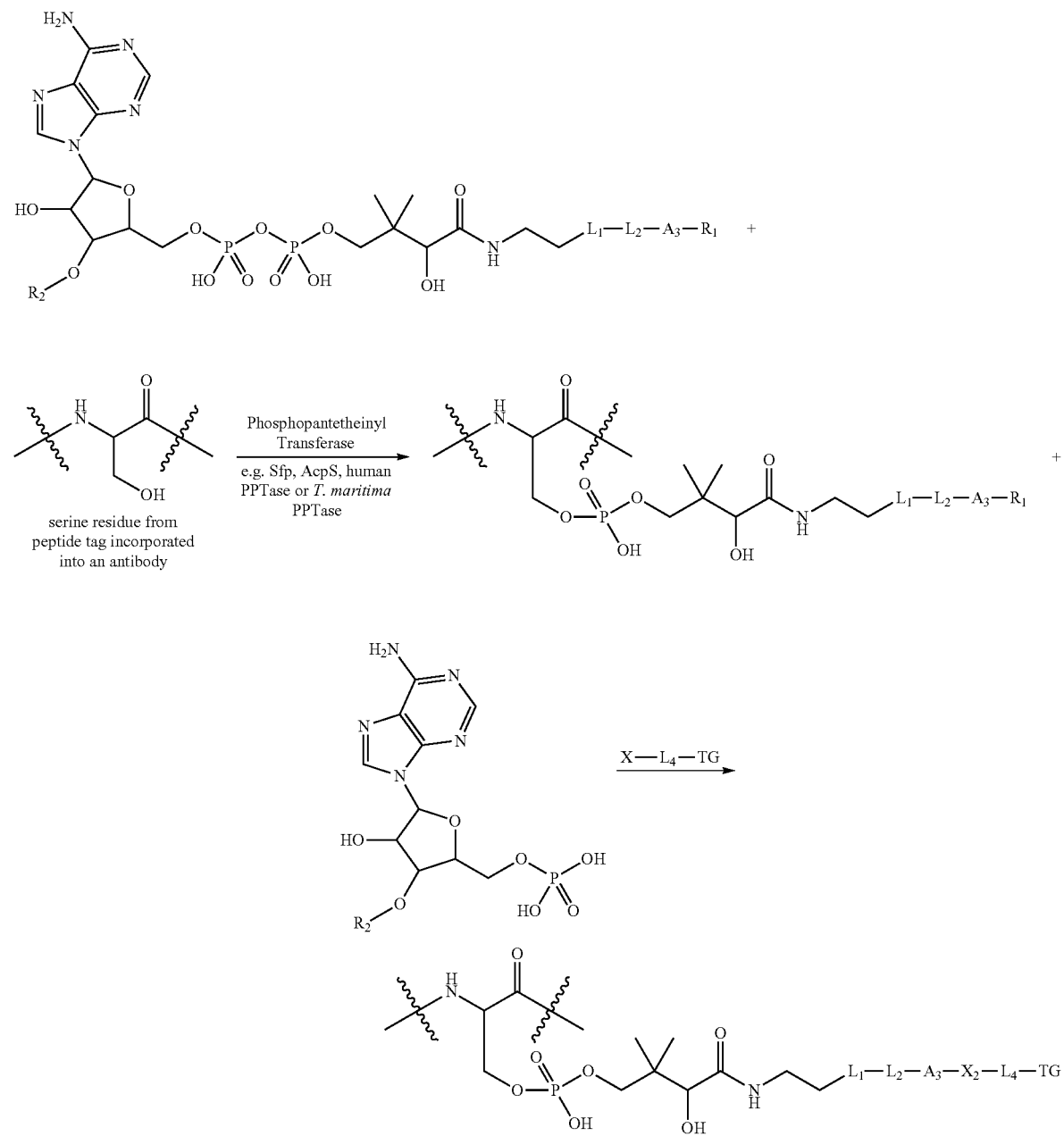

where X, $R_1$, $R_2$, $L_1$, $L_2$, $X_2$, $A_3$, $L_4$ and TG are as defined herein.

The Two-Step Method of Scheme (IIc) includes the steps of:
(a) providing a modified antibody or antigen binding fragment thereof which has been engineered to contain a short peptide tag, and wherein the peptide tag is a substrate of an enzyme having 4'-phosphopantetheinyl transferase activity;
(b) labeling the modified antibody or antigen binding fragment thereof by:
  incubating the modified antibody or antigen binding fragment thereof with an enzyme having 4'-phosphopantetheinyl transferase activity in the presence of a compound of Formula (F),

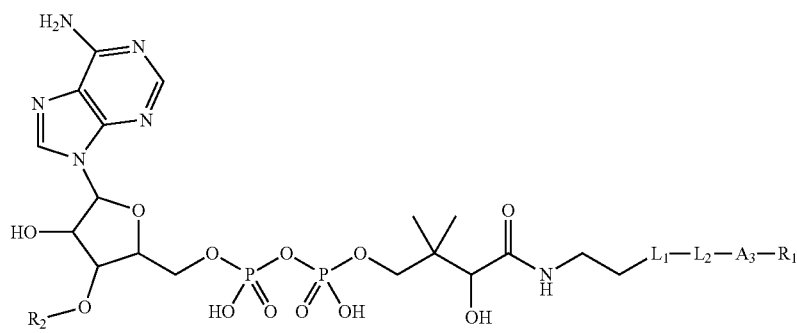

Formula (F)

thereby attaching an activated 4'-phosphopantetheinyl group of Formula (F-a) to the short peptide tag;

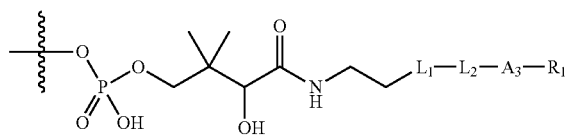

Formula (F-a)

and (c) reacting the activated 4'-phosphopantetheinyl group with a compound of Formula (IIe):

X-$L_4$-TG          Formula (IIe), where X, $R_1$, $R_2$, $L_1$, $L_2$, $L_3$, $L_4$ and TG are as defined herein.

As a result of the Two-Step Method of Scheme (IIc) the terminal group is attached to the modified antibody or antigen binding fragment thereof via a linker having the structure according to Formula (II-f):

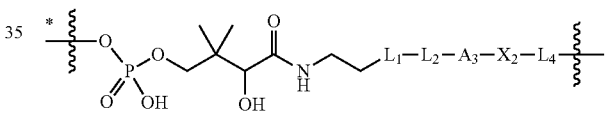

Formula (II-f)

where $L_1$, $L_2$, $A_3$, $X_2$ and $L_4$ are as defined herein and the * denotes that the modified 4'-phosphopantetheinyl moiety is attached to the small peptide tag.

Another embodiment of the Two-Step Method is shown in Scheme (IId).

Scheme (IId)

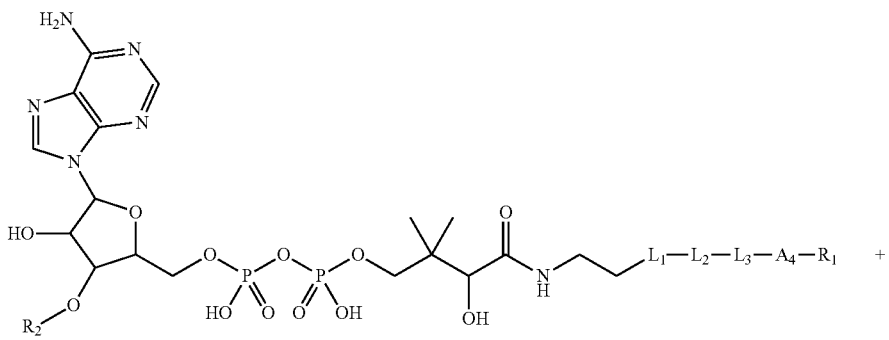

+

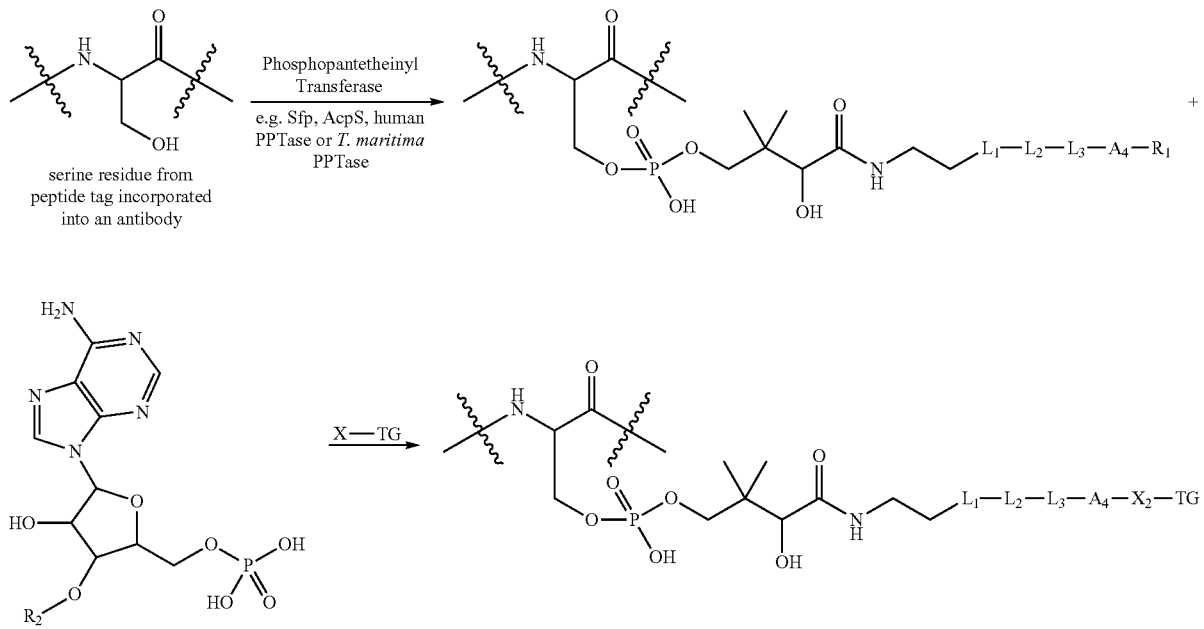

serine residue from peptide tag incorporated into an antibody where X, $R_1$, $R_2$, $L_1$, $L_2$, $L_3$, $A_4$, $X_2$ and TG are as defined herein.

The Two-Step Method of Scheme (IId) includes the steps of:
(a) providing a modified antibody or antigen binding fragment thereof which has been engineered to contain a short peptide tag, and wherein the peptide tag is a substrate of an enzyme having 4'-phosphopantetheinyl transferase activity;
(b) labeling the modified antibody or antigen binding fragment thereof by:
incubating the modified antibody or antigen binding fragment thereof with an enzyme having 4'-phosphopantetheinyl transferase activity in the presence of a compound of Formula (G), thereby attaching an activated 4'-phosphopantetheinyl of Formula (G-a) to the short peptide tag;

Formula (G-a)

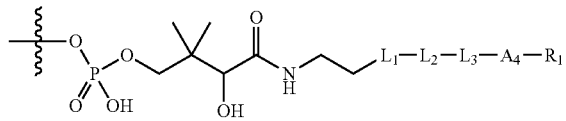

and
(c) reacting the activated 4'-phosphopantetheinyl group with a compound of Formula (II-g):

X-TG           Formula (II-g), where X, $R_1$, $R_2$, $L_1$, $L_2$, $L_3$, $L_4$ and TG are as defined herein.

Formula (G)

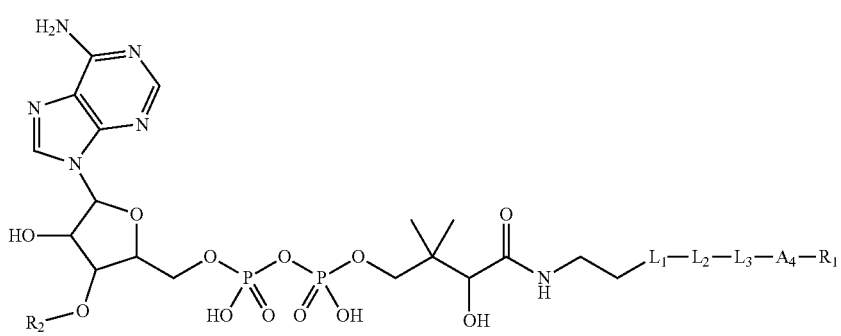

As a result of the Two-Step Method of Scheme (IId) the terminal group is attached to the modified antibody or antigen binding fragment thereof via a linker having the structure according to Formula (II-h):

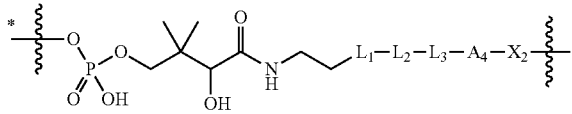

Formula (II-h)

where $L_1$, $L_2$, $L_3$, $A_4$ and $X_2$ are as defined herein and the * denotes that the modified 4'-phosphopantetheinyl moiety is attached to the small peptide tag.

In certain embodiments of the Two-Step Methods described herein, the modified antibody or antigen binding fragment thereof is contacted with a compound having the structure of Formula (D), Formula (E), Formula (F) or Formula (G) and a 4'-phosphopantetheinyl transferase enzyme that is co-expressed in the same cell as the expressed modified antibody or antigen binding fragment thereof. In certain embodiments of the Two-Step Methods described herein, the modified antibody or antigen binding fragment thereof is contacted in the cell culture media with a compound having the structure of Formula (D), Formula (E), Formula (F) or Formula (G) and 4'-phosphopantetheinyl transferase enzyme produced in the same or in another cell. In certain embodiments of the Two-Step Methods described herein, the 4'-phosphopantetheinyl transferase enzyme is immobilized on solid support. In certain embodiments the solid support is optionally comprised of a polymer on a bead or a column.

Table 4 shows certain embodiments of the activated 4'-phosphopantetheinyl groups of Formula (D-a) and compounds of Formula (II-a) used in the Two-step methods and the Three-step methods described herein and the resulting modified serine located in the modified antibody or antigen binding fragment thereof. Note $A_1$, $L_2$, $L^3$, $L_4$, $R_5$, $R_6$, $R_7$, $R_8$ and TG are as defined herein, and Y is

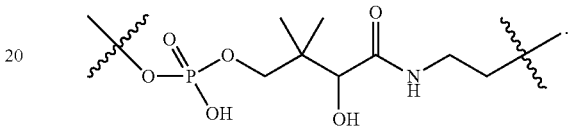

TABLE 4

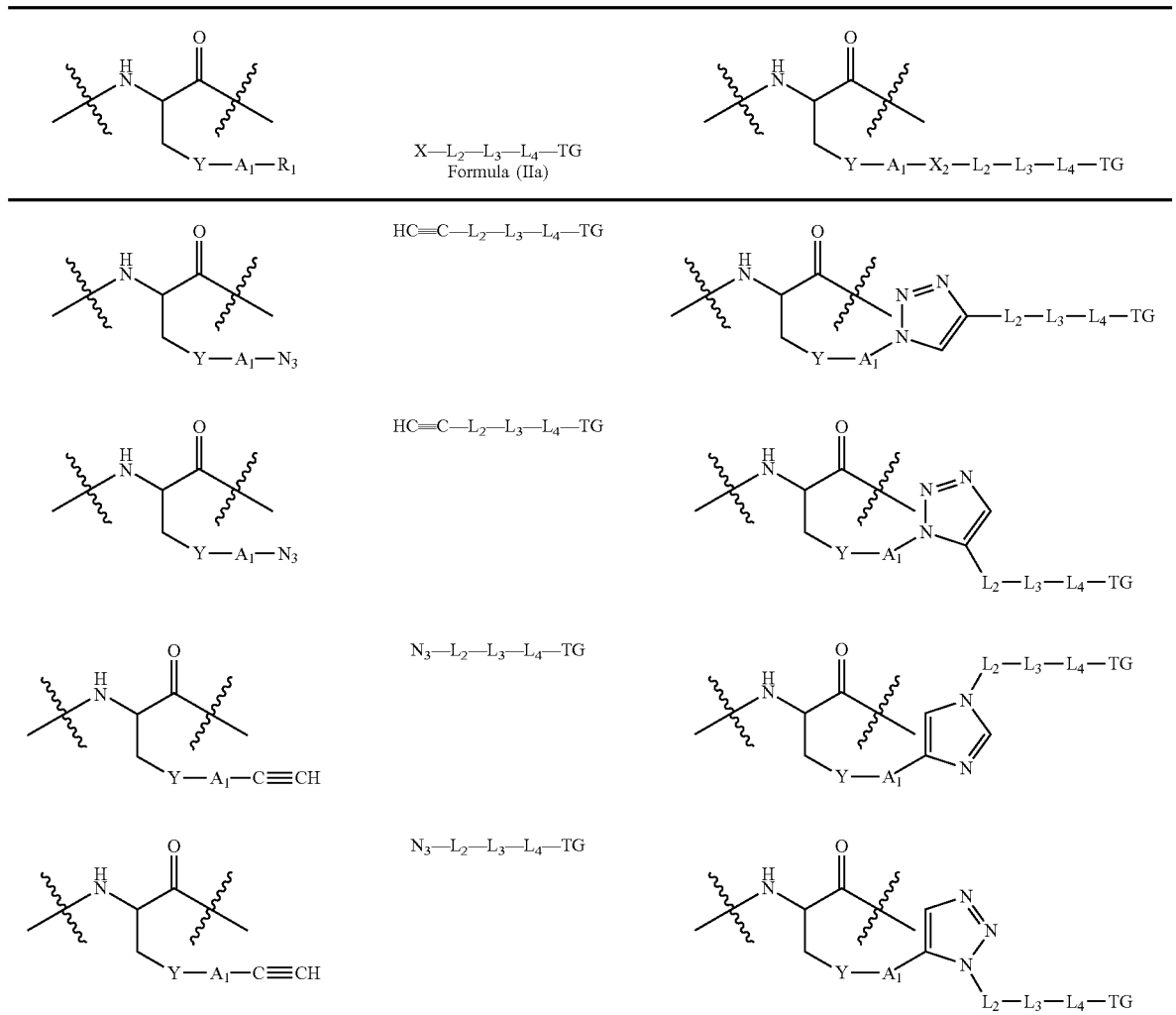

TABLE 4-continued

TABLE 4-continued
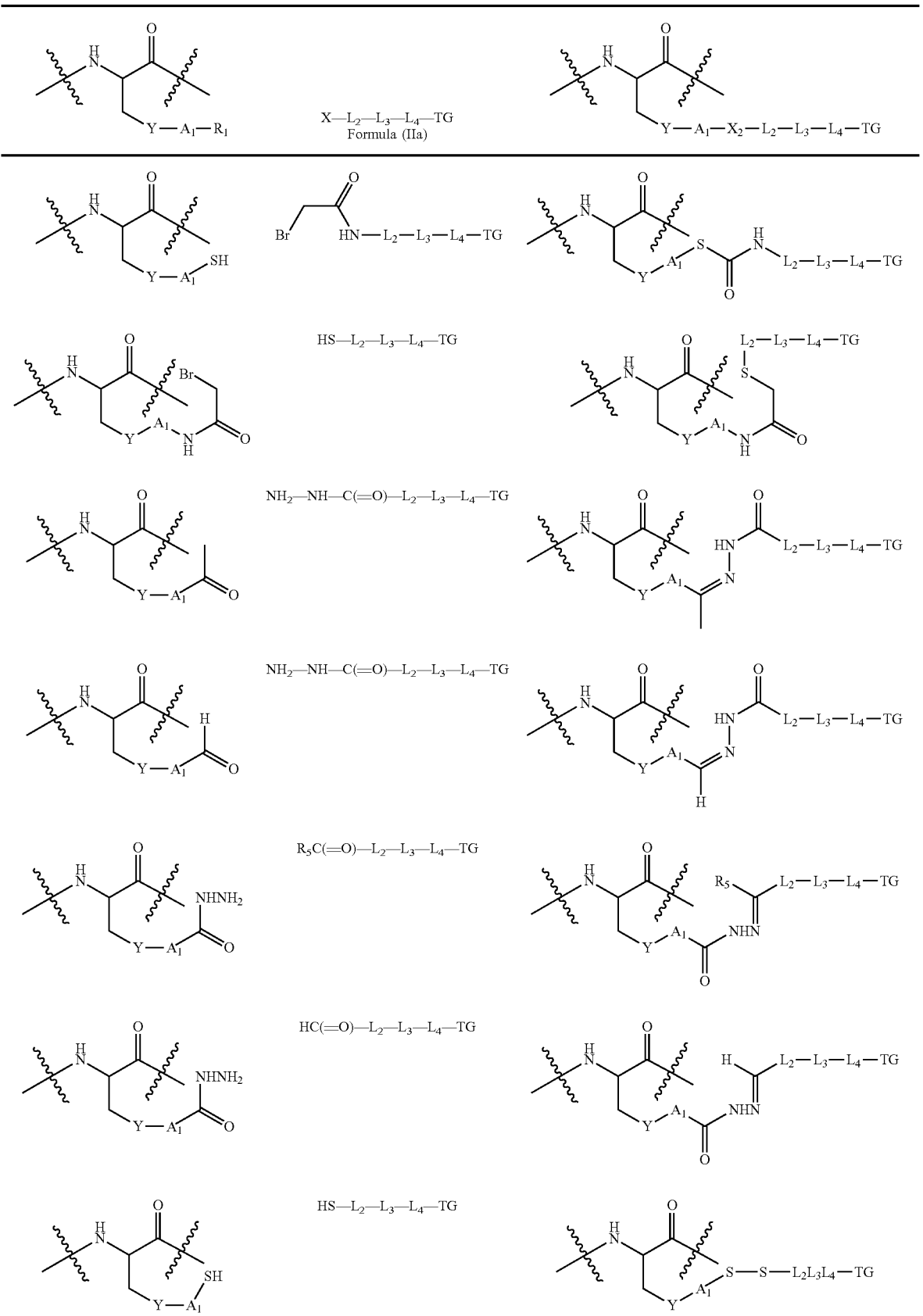

TABLE 4-continued
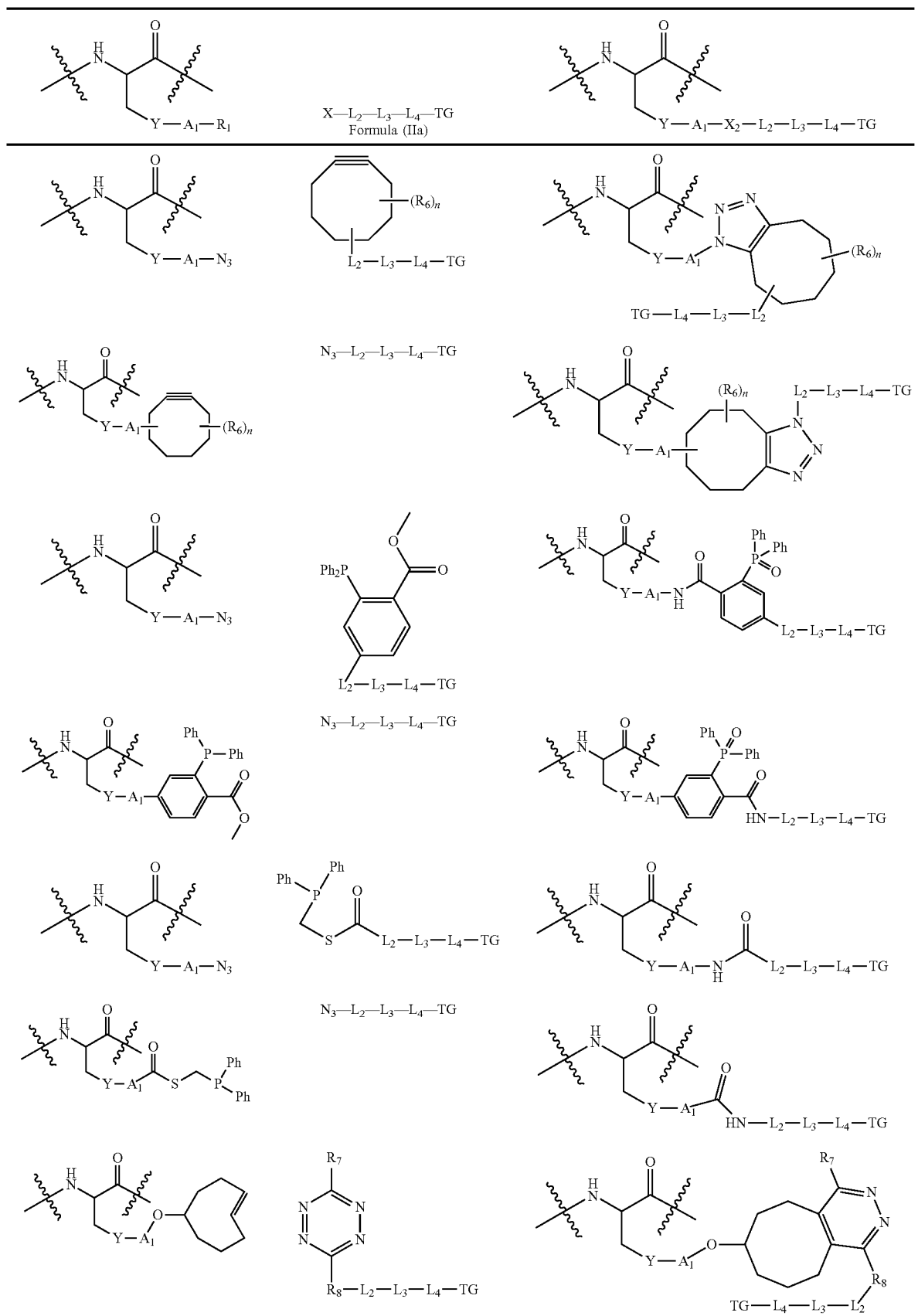

TABLE 4-continued
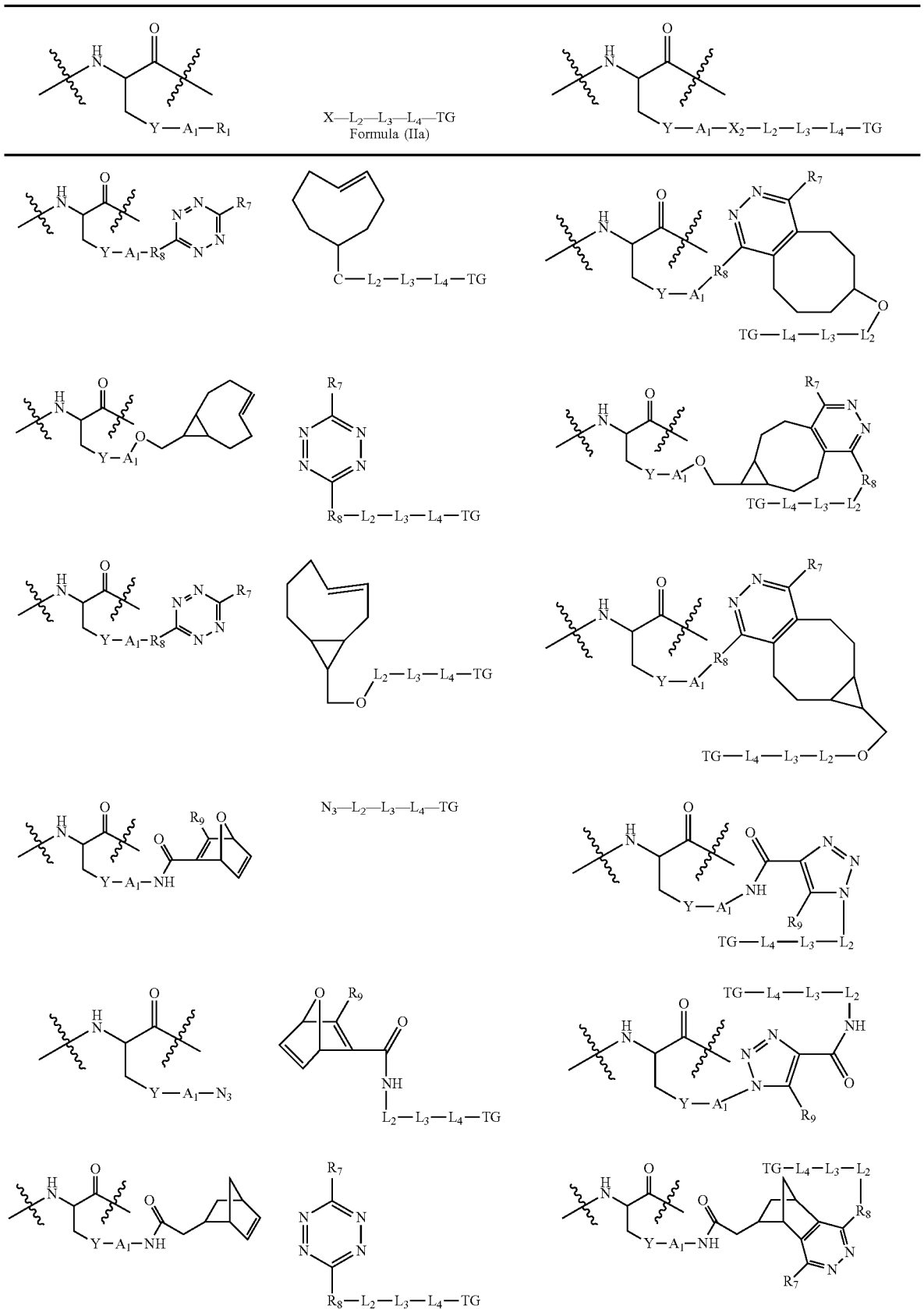

TABLE 4-continued

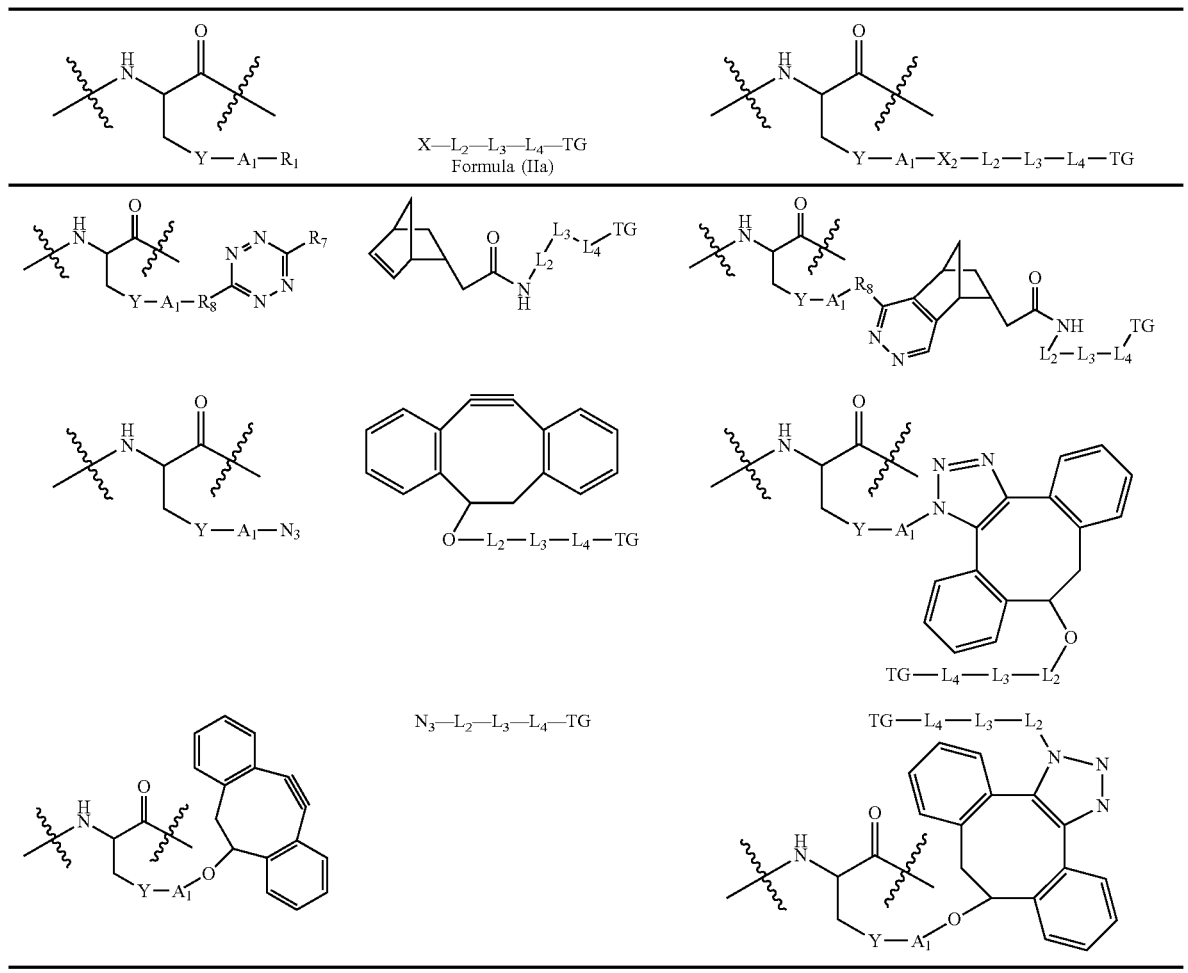

Table 5 shows certain embodiments of the activated 4'-phosphopantetheinyl groups of Formula (E-a) and compounds of Formula (II-c) used in the Two-step methods and the Three-step methods described herein and the resulting modified serine located in the modified antibody or antigen binding fragment thereof. Note $L_1$, $A_2$, $L_3$, $L_4$, $R_5$, $R_6$, $R_7$, $R_8$ and TG are as defined herein, and Y is

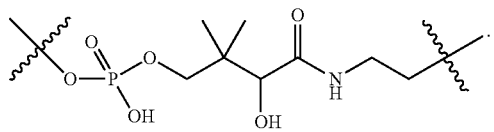 [SMILES: *CCNC(=O)C(O)C(C)(C)COP(=O)(O)O*]

TABLE 5

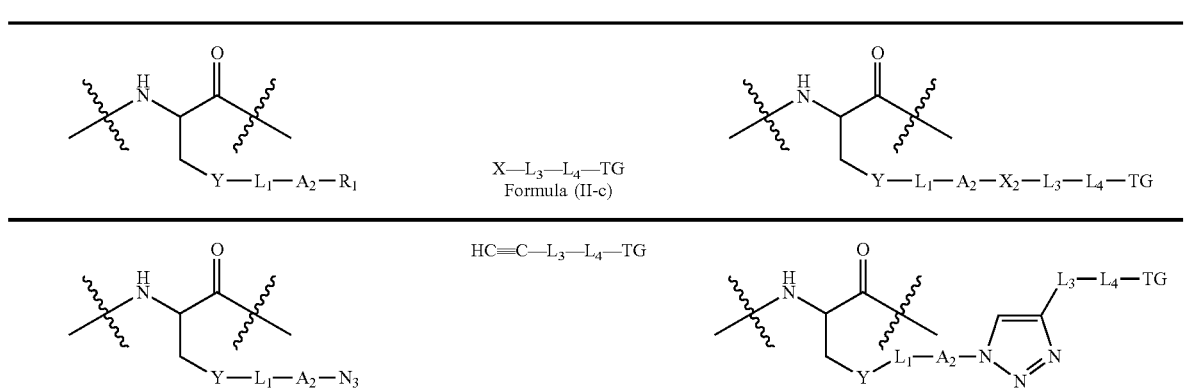

TABLE 5-continued

TABLE 5-continued
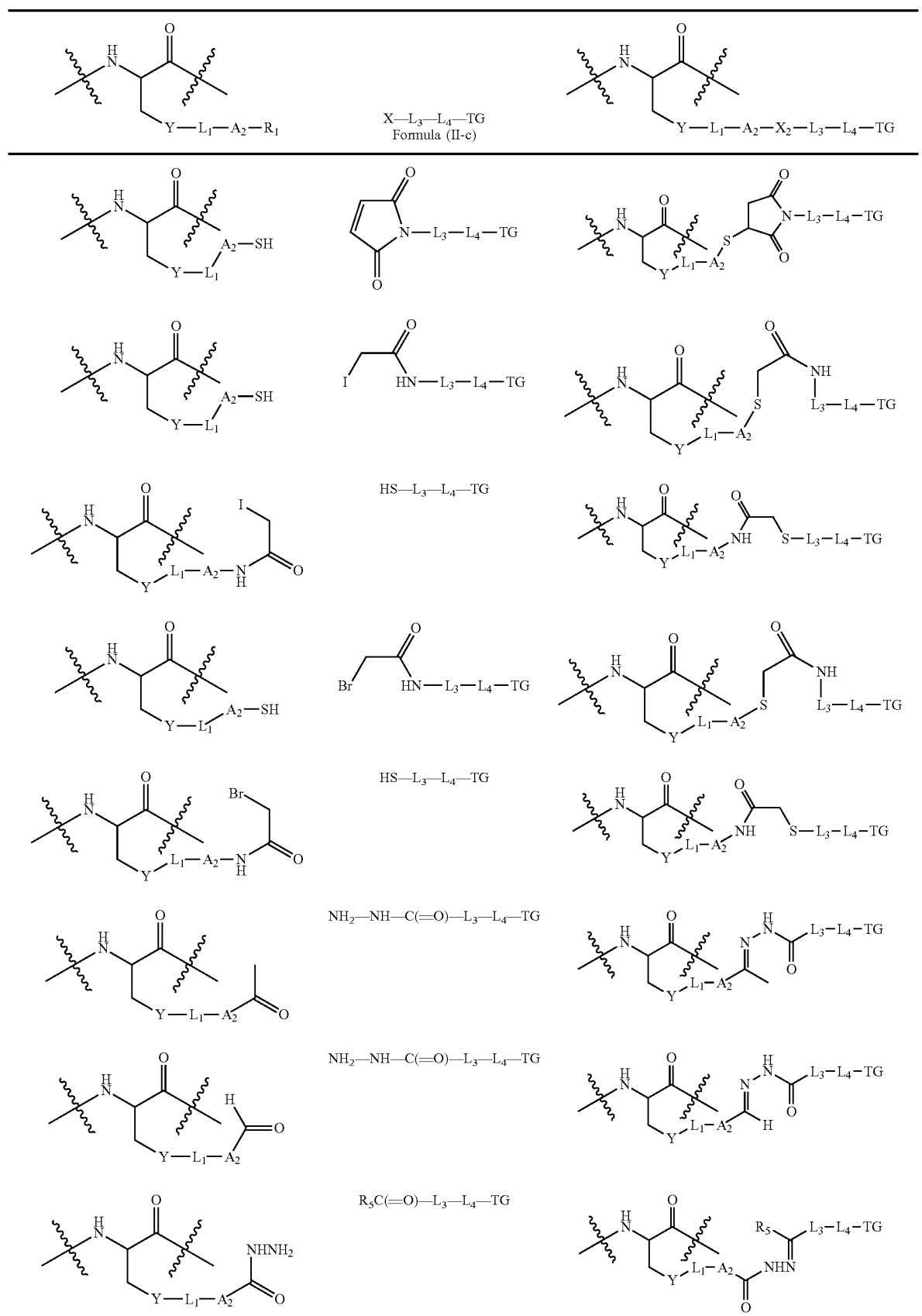

TABLE 5-continued
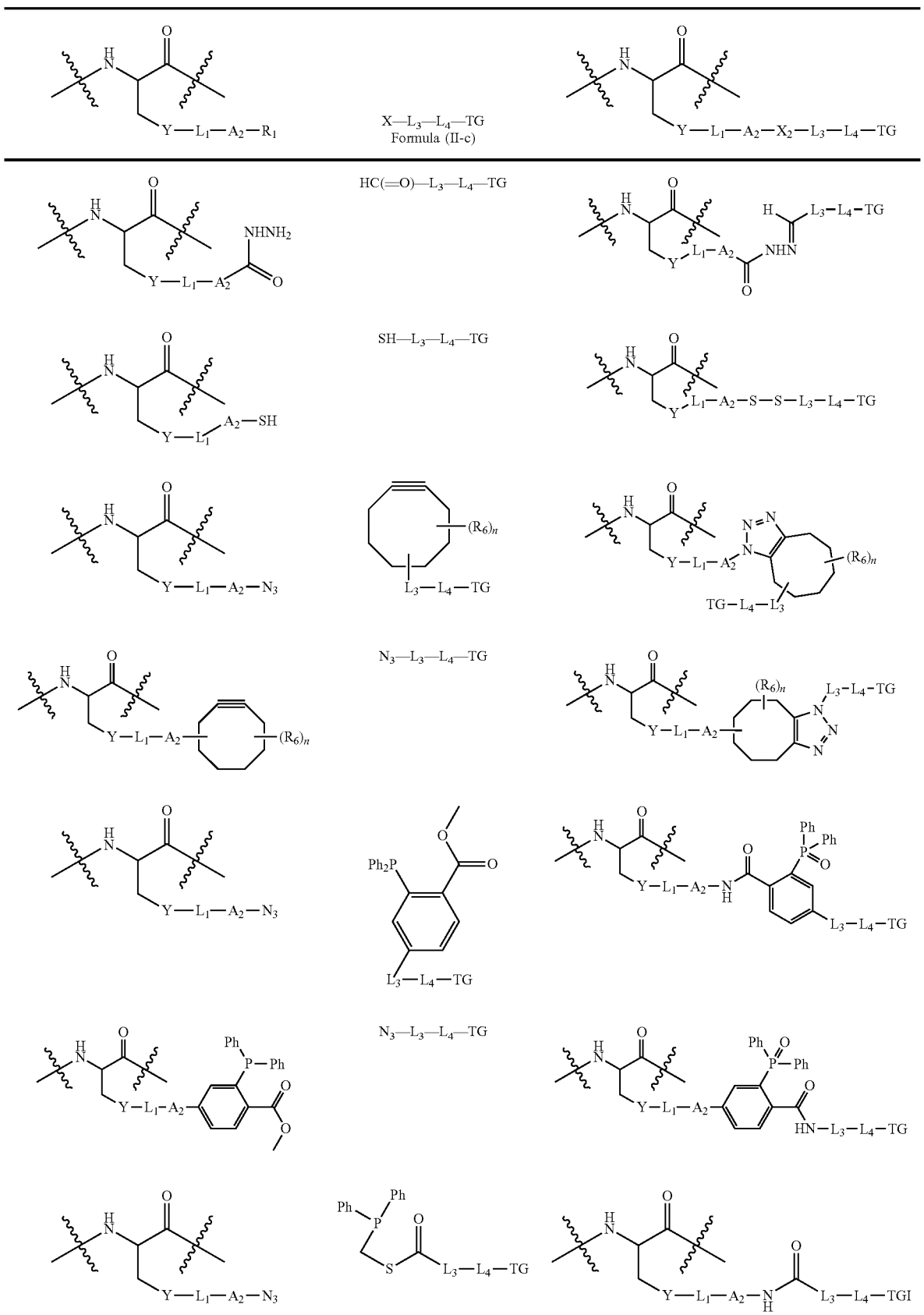

TABLE 5-continued
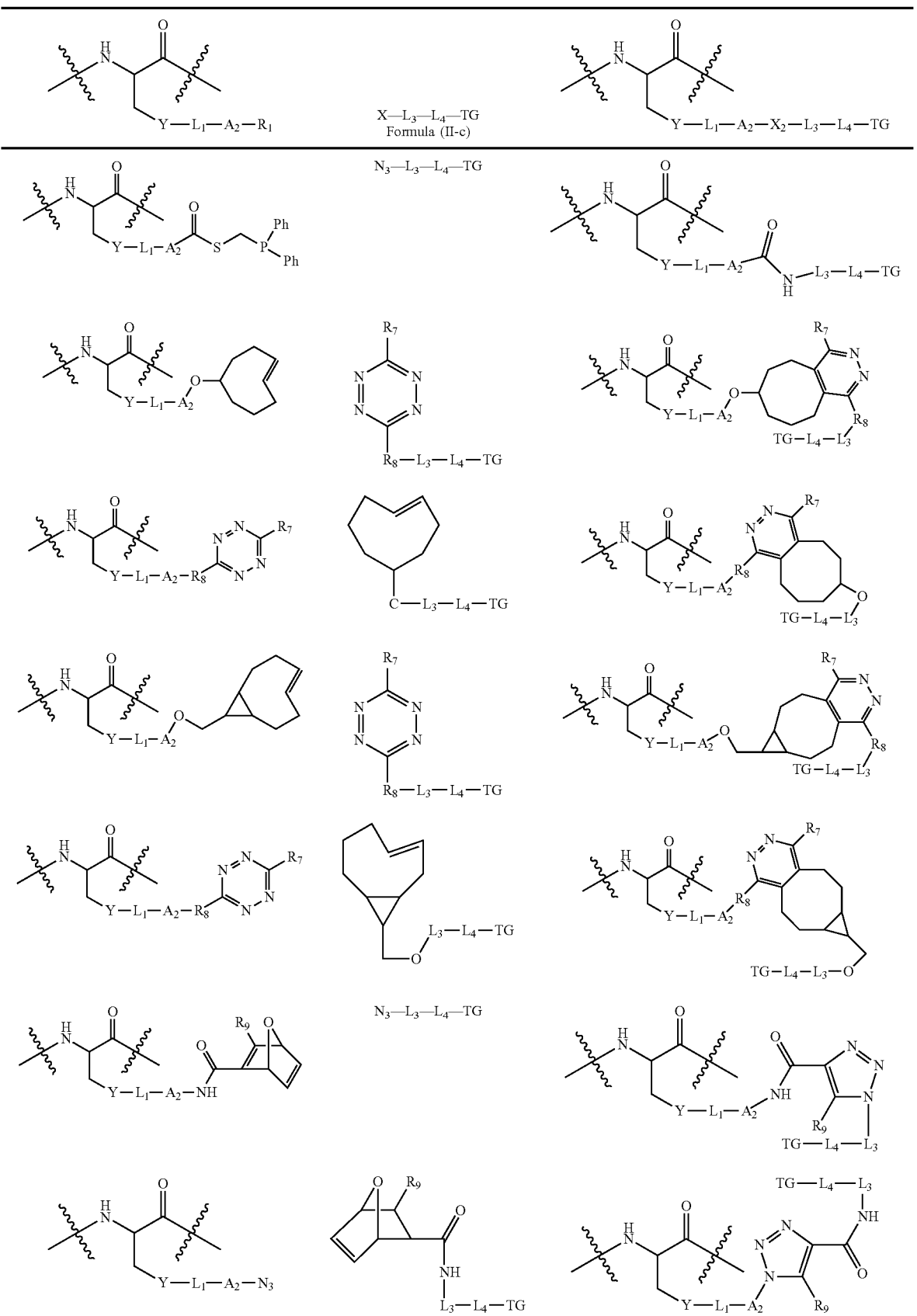

TABLE 5-continued

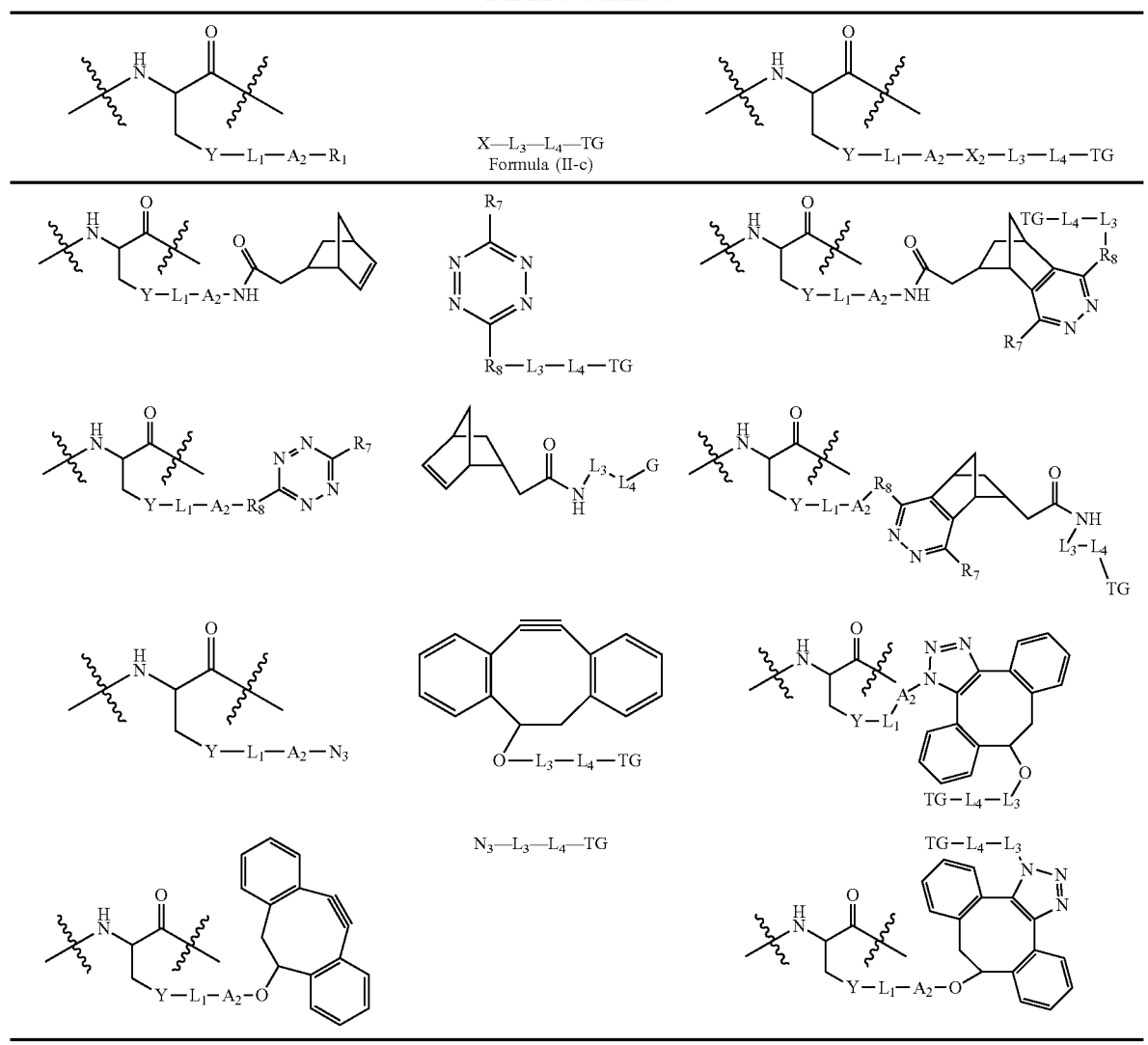

Table 6 shows certain embodiments of the activated 4'-phosphopantetheinyl groups of Formula (F-a) and compounds of Formula (II-e) used in the Two-step methods and the Three-step methods described herein and the resulting modified serine located in the modified antibody or antigen binding fragment thereof. Note $L_1$, $L_2$, $A_3$, $L_4$, $R_5$, $R_6$, $R_7$, $R_8$ and TG are as defined herein, and Y is

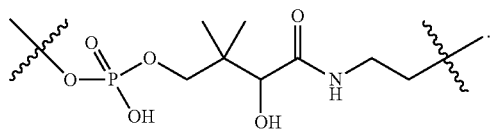 [SMILES: *CCNC(=O)C(O)C(C)(C)COP(=O)(O)O*]

TABLE 6

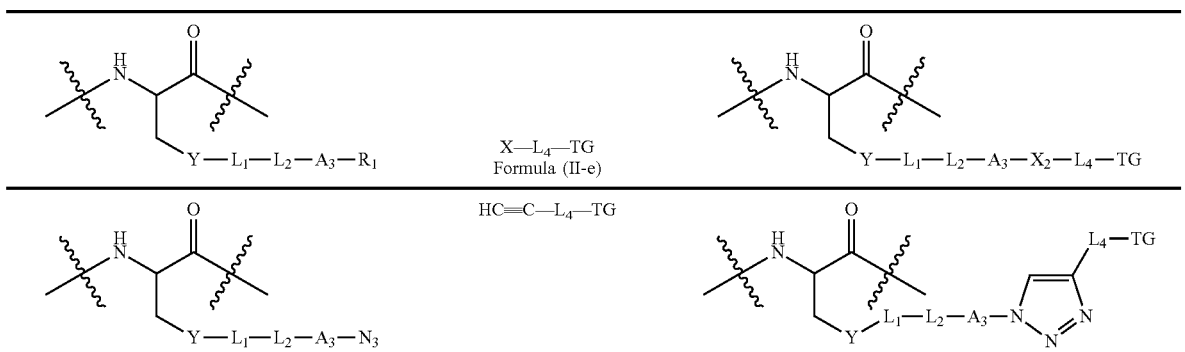

US 9,585,970 B2
TABLE 6-continued
| 203 | | 204 |
|---|---|---|
| 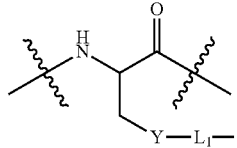 | X—L₄—TG<br>Formula (II-e) | 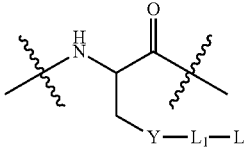 |
| 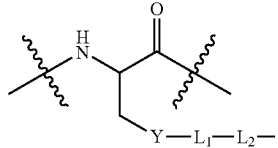 | HC≡C—L₄—TG | 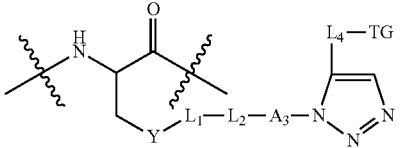 |
| 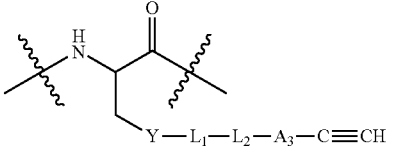 | N₃—L₄—TG | 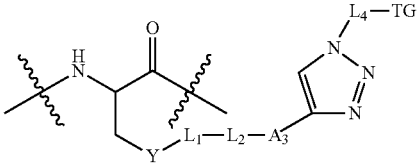 |
| 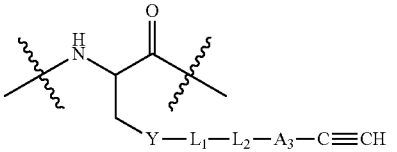 | N₃—L₄—TG | 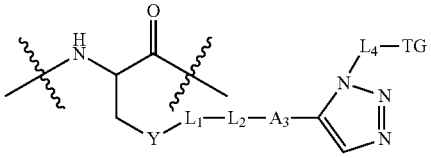 |
| 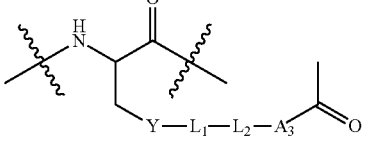 | NH₂—O—L₄—TG | 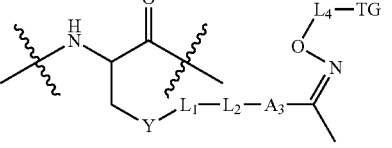 |
| 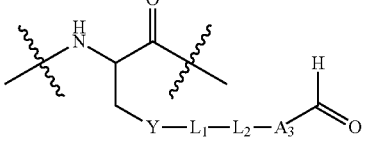 | NH₂—O—L₄—TG | 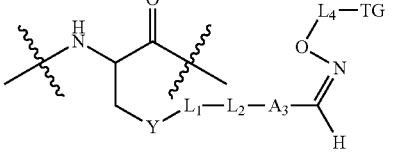 |
| 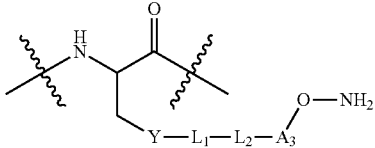 | CH₃C(=O)—L₄—TG | 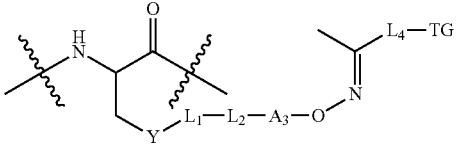 |
| 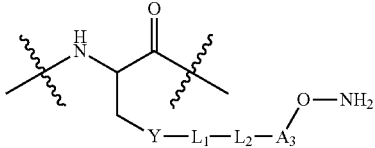 | HC(=O)—L₄—TG | 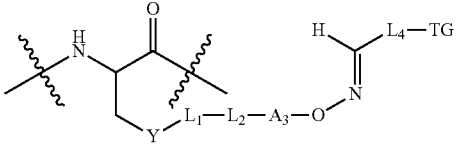 |
| 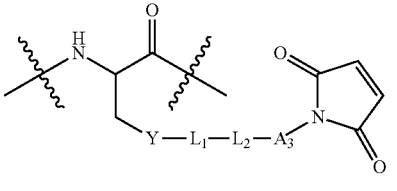 | HS—L₄—TG | 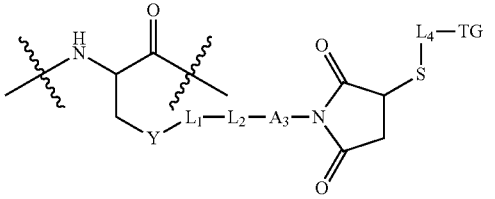 |

TABLE 6-continued
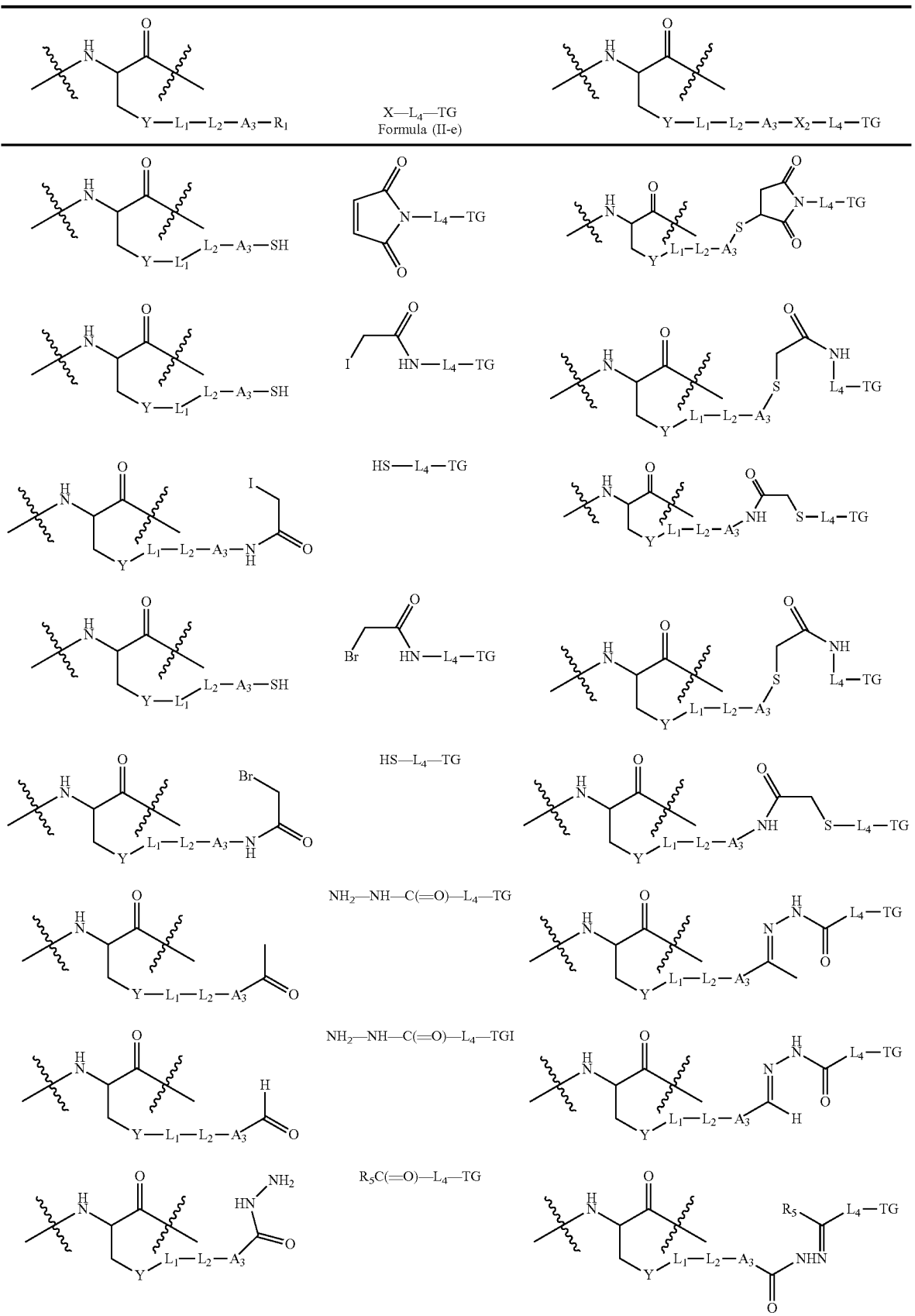

TABLE 6-continued
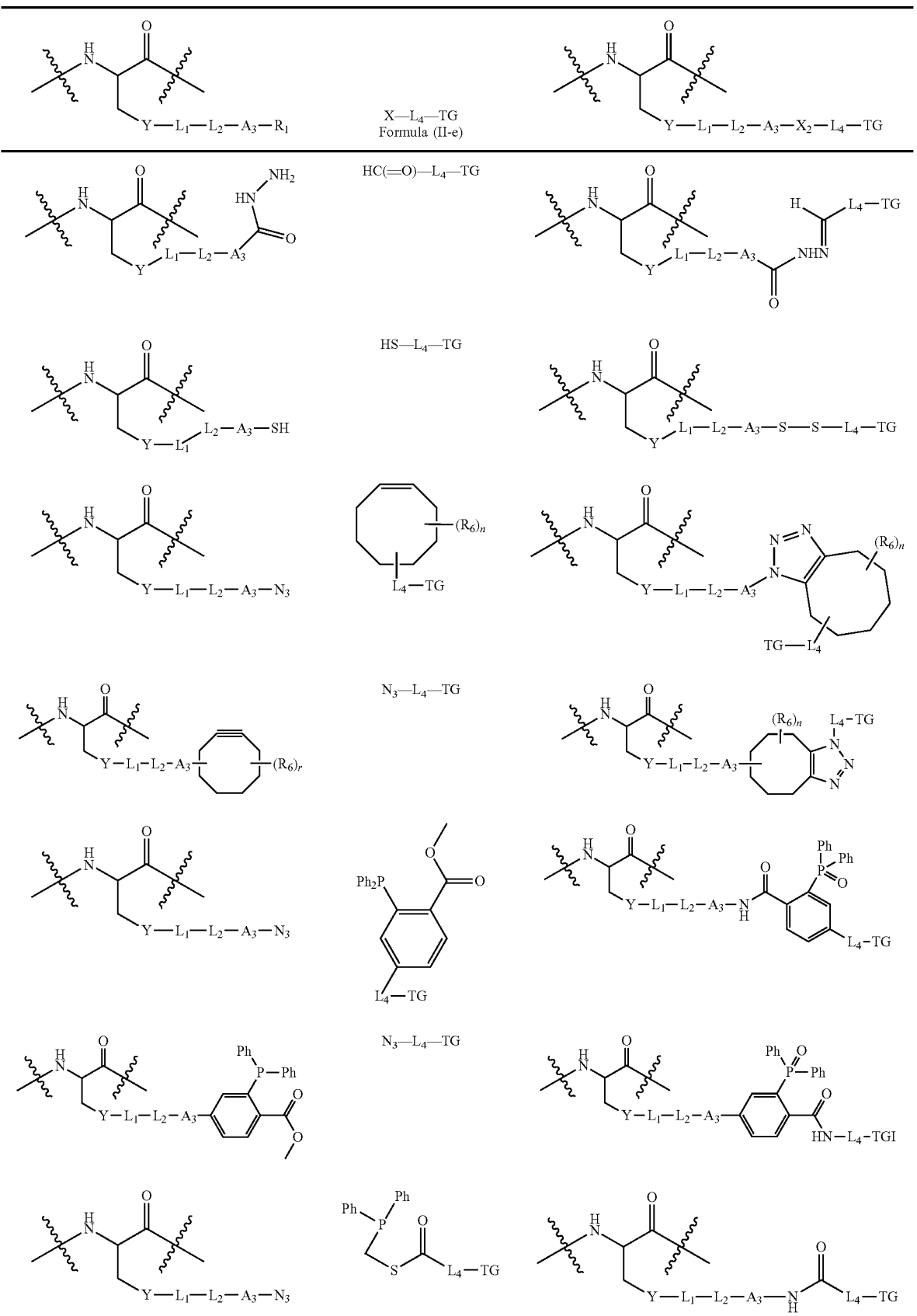

TABLE 6-continued
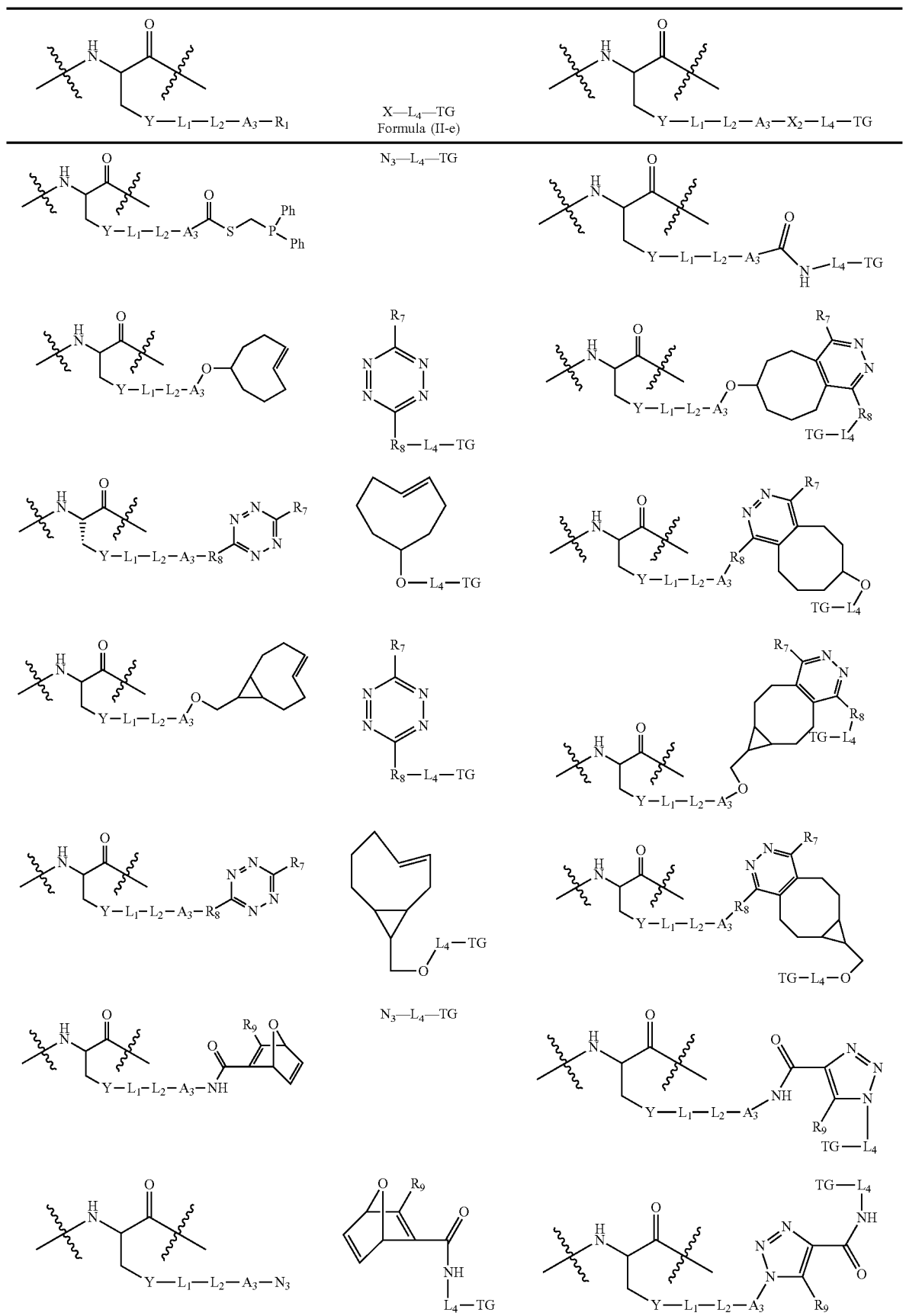

TABLE 6-continued

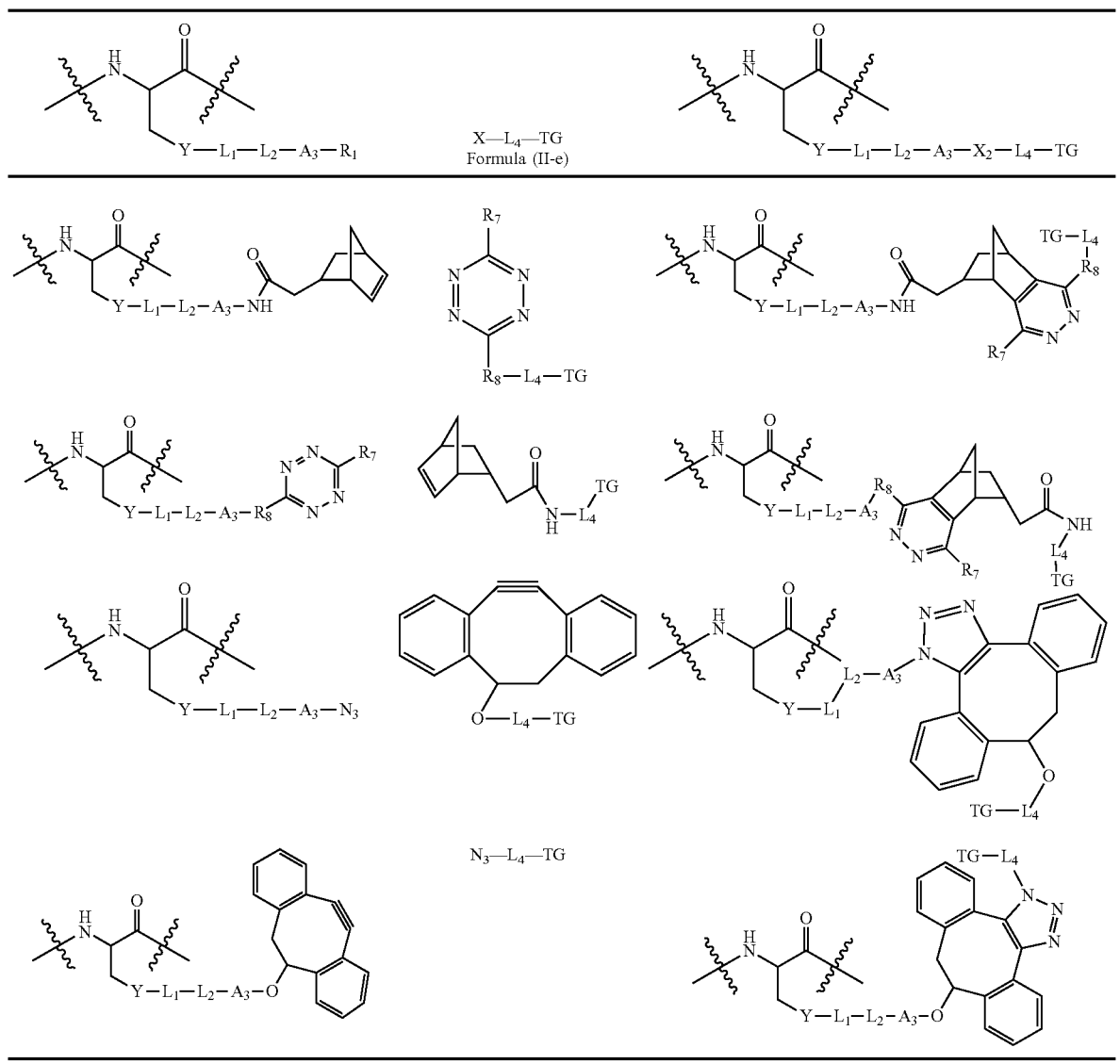

45

Table 7 shows certain embodiments of the activated 4'-phosphopantetheinyl groups of Formula (G-a) and compounds of Formula (II-g) used in the Two-step methods and the Three-step methods described herein and the resulting modified serine located in the modified antibody or antigen binding fragment thereof. Note $L_1$, $L_2$, $L_3$, $A_4$, $R_5$, $R_6$, $R_7$, $R_8$ and TG are as defined herein, and Y is

TABLE 7

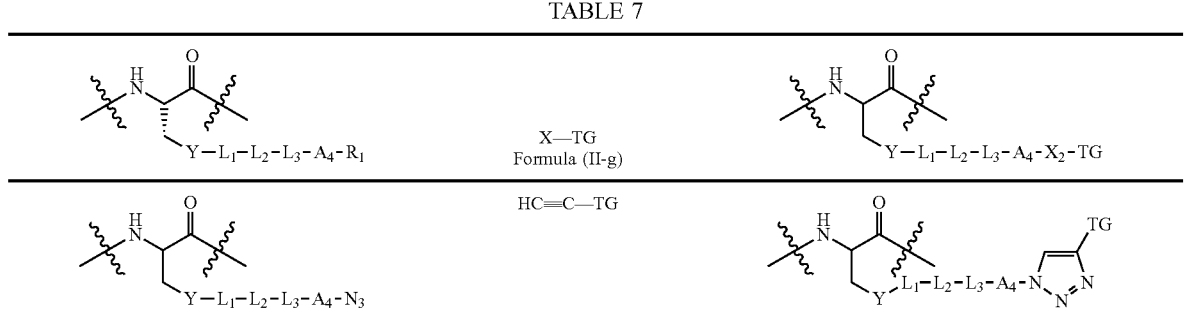

TABLE 7-continued

| 213 | | 214 |
|---|---|---|
| ~~NH-C(=O)~~-Y-L₁-L₂-L₃-A₄-R₁ | X—TG<br>Formula (II-g) | ~~NH-C(=O)~~-Y-L₁-L₂-L₃-A₄-X₂-TG |
| ~~NH-C(=O)~~-Y-L₁-L₂-L₃-A₄-N₃ | HC≡C—TG | ~~NH-C(=O)~~-Y-L₁-L₂-L₃-A₄-triazole-TG |
| ~~NH-C(=O)~~-Y-L₁-L₂-L₃-A₄-C≡CH | N₃—TG | ~~NH-C(=O)~~-Y-L₁-L₂-L₃-A₄-triazole-TG |
| ~~NH-C(=O)~~-Y-L₁-L₂-L₃-A₄-C≡CH | N₃—TG | ~~NH-C(=O)~~-Y-L₁-L₂-L₃-A₄-triazole-TG |
| ~~NH-C(=O)~~-Y-L₁-L₂-L₃-A₄-C(=O)CH₃ | NH₂—O—TG | ~~NH-C(=O)~~-Y-L₁-L₂-L₃-A₄-C(CH₃)=N-O-TG |
| ~~NH-C(=O)~~-Y-L₁-L₂-L₃-A₄-CHO | NH₂—O—TG | ~~NH-C(=O)~~-Y-L₁-L₂-L₃-A₄-CH=N-O-TG |
| ~~NH-C(=O)~~-Y-L₁-L₂-L₃-A₄-O-NH₂ | CH₃C(=O)—TG | ~~NH-C(=O)~~-Y-L₁-L₂-L₃-A₄-O-N=C(CH₃)-TG |
| ~~NH-C(=O)~~-Y-L₁-L₂-L₃-A₄-O-NH₂ | HC(=O)—TG | ~~NH-C(=O)~~-Y-L₁-L₂-L₃-A₄-O-N=CH-TG |
| ~~NH-C(=O)~~-Y-L₁-L₂-L₃-A₄-maleimide | HS—TG | ~~NH-C(=O)~~-Y-L₁-L₂-L₃-A₄-succinimide-S-TG |
| ~~NH-C(=O)~~-Y-L₁-L₂-L₃-A₄-SH | maleimide-N-TG | ~~NH-C(=O)~~-Y-L₁-L₂-L₃-A₄-S-succinimide-N-TG |
| ~~NH-C(=O)~~-Y-L₁-L₂-L₃-A₄-SH | I-CH₂-C(=O)-NH-TG | ~~NH-C(=O)~~-Y-L₁-L₂-L₃-A₄-S-CH₂-C(=O)-NH-TG |

TABLE 7-continued
| | | |
|---|---|---|
| 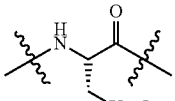 | X—TG<br>Formula (II-g) | 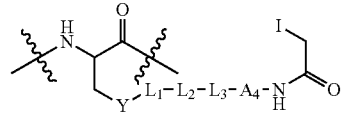 |
| 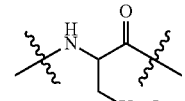 | HS—TG |  |
| 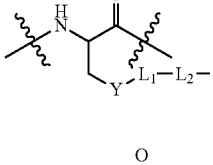 | 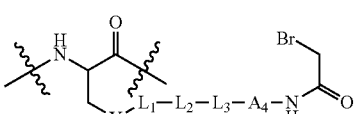 | 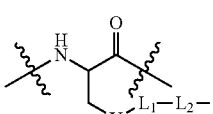 |
| 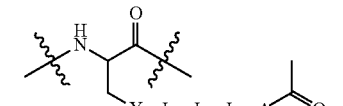 | HS—TG | 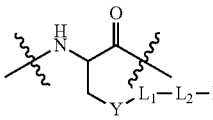 |
| 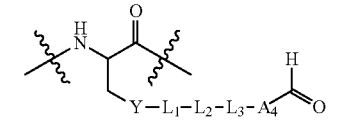 | NH$_2$—NH—C(=O)—TG | 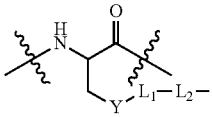 |
| 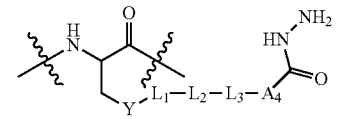 | NH$_2$—NH—C(=O)—TG | 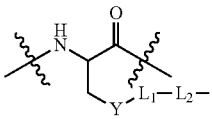 |
| 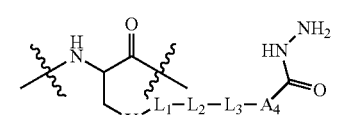 | R$_5$C(=O)—TG | 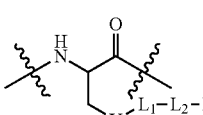 |
| 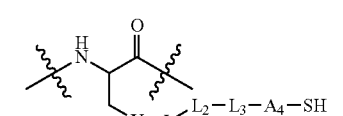 | HC(=O)—TG | 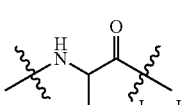 |
| 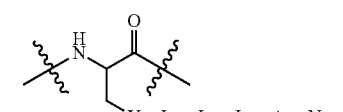 | HS—TG | 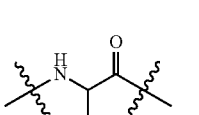 |
| 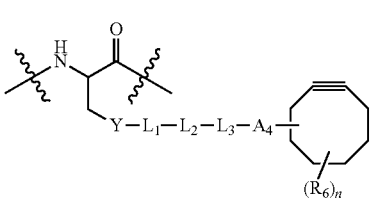 | 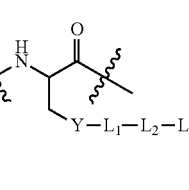 | |

TABLE 7-continued
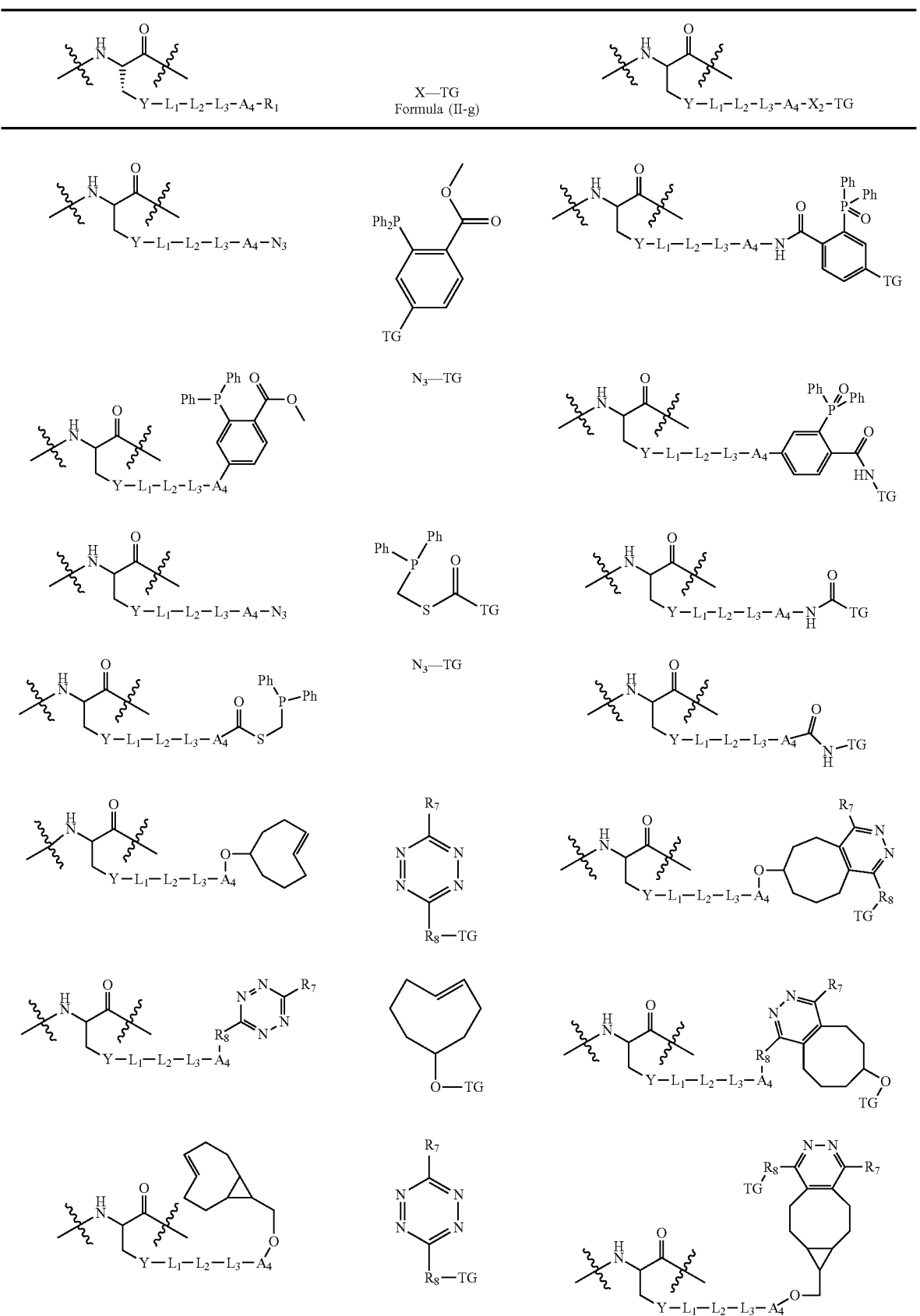

TABLE 7-continued

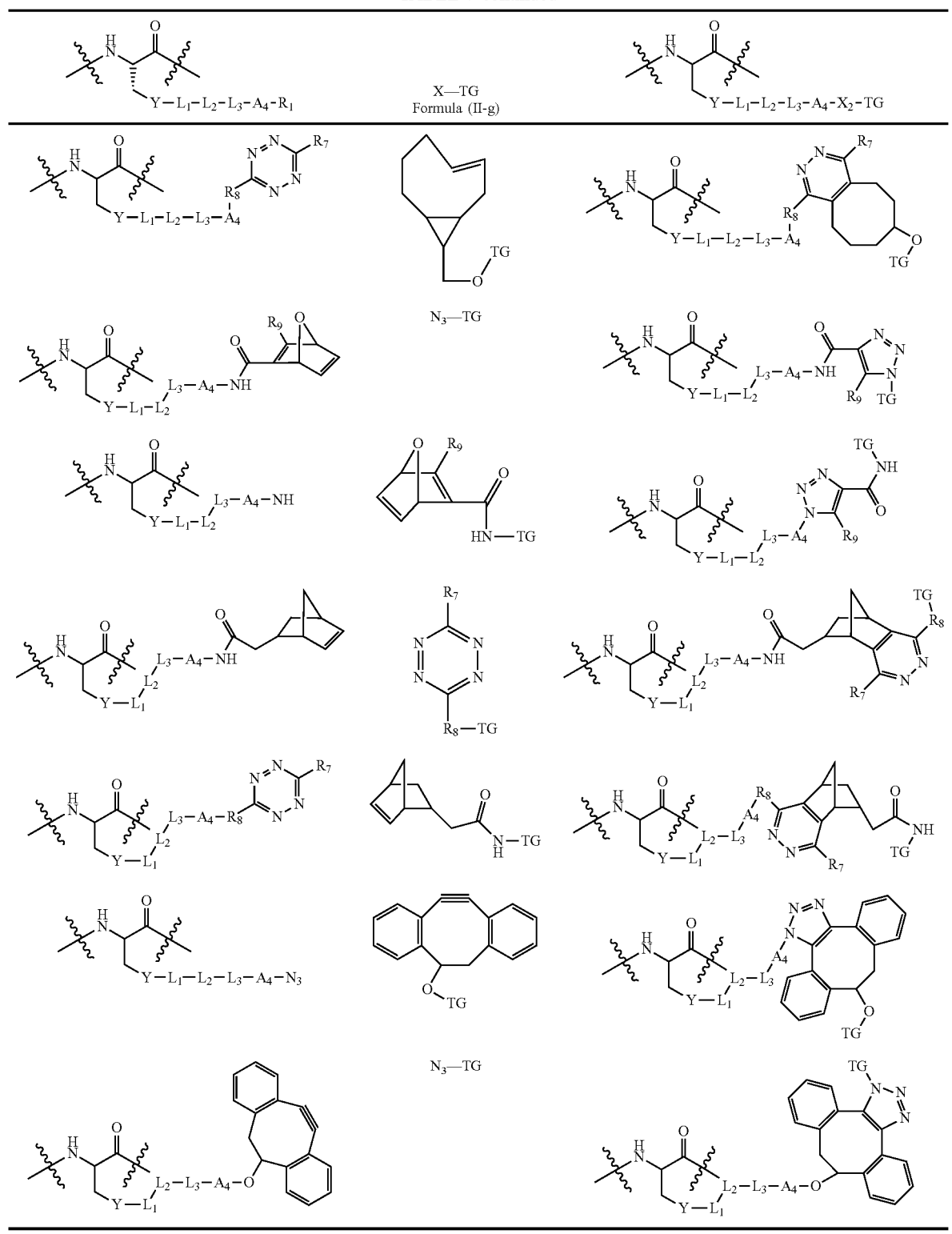

Three-Step Method

Alternatively, the modified antibodies or antigen binding fragment thereof provided herein are site-specifically labeled by a three-step method, wherein, in the first step a protected ppan prosthetic group of CoA, or a protected modified ppan prosthetic group of the CoA analogue, is attached to the short peptide tag by a phosphodiester bond formed between the 4'-phosphopantetheinyl moiety and the hydroxyl group of the conserved serine residue of the short peptide tag incorporated into the antibody. In the second step the protected ppan prosthetic group of CoA, or protected modified ppan prosthetic group of the CoA analogue, is deprotected; thereby generating a reactive functional group ($R_1$). In the third step a terminal group (TG) linked, or directly attached to, a group which is reactive with the functional group ($R_1$) is reacted with the functional group ($R_1$) on the ppan prosthetic group of CoA, or on the modified ppan prosthetic group of the CoA analogue, thereby directly attaching the terminal group to the modified antibody or antigen binding fragment thereof or attaching the terminal group to the modified antibody or antigen binding fragment thereof via a Linker Unit (LU).

One embodiment of the Three-Step Method is shown in Scheme (IIIa).

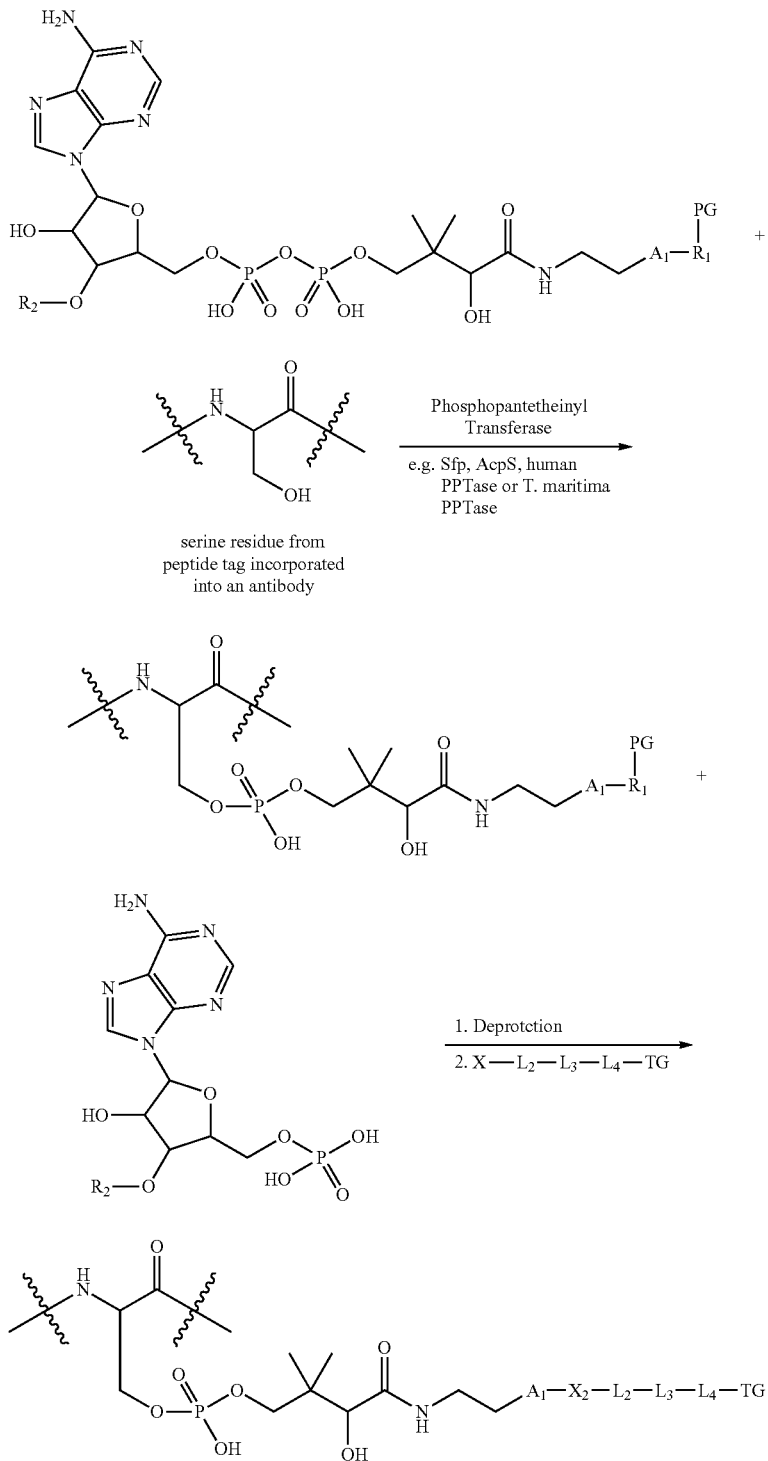

wherein X and a corresponding $R_1$ are as given in Table 3, and where PG is a protecting group and $R_2$, $A_1$, $L_2$, $X_2$, $L_3$, $L_4$ and TG are as defined herein.

The Three-Step Method of Scheme (IIIa) includes the steps of:
(a) providing a modified antibody or antigen binding fragment thereof which has been engineered to contain a short peptide tag, and wherein the peptide tag is a substrate of an enzyme having 4'-phosphopantetheinyl transferase activity;
(b) labeling the modified antibody or antigen binding fragment thereof by:
  incubating the modified antibody or antigen binding fragment thereof with an enzyme having 4'-phosphopantetheinyl transferase activity in the presence of a compound of Formula H, Formula (H)

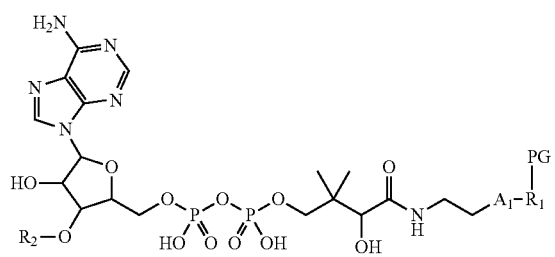

thereby attaching a protected 4'-phosphopantetheinyl group of Formula (H-a) to the short peptide tag;

Formula (H-a)

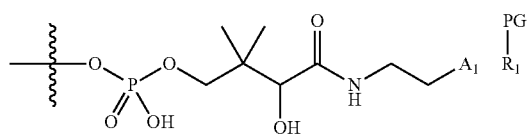

(c) deprotecting the protected 4'-phosphopantetheinyl group to give an activated 4'-phosphopantetheinyl group of Formula (D-a)

Formula (D-a)

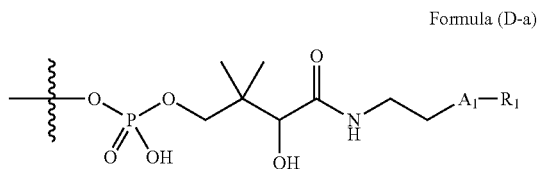

and (d) reacting the activated 4'-phosphopantetheinyl group with a compound of Formula (IIa):

$X\text{-}L_2\text{-}L_3\text{-}L_4\text{-}TG$      Formula (II-a), where PG is a protecting group and X, $R_1$, $R_2$, $A_1$, $L_2$, $L_3$, $L_4$ and TG are as defined herein.

As a result of the Three-Step Method of Scheme (IIIa) the terminal group is attached to the modified antibody or antigen binding fragment thereof via a linker having the structure according to Formula (IIb):

Formula (II-b)

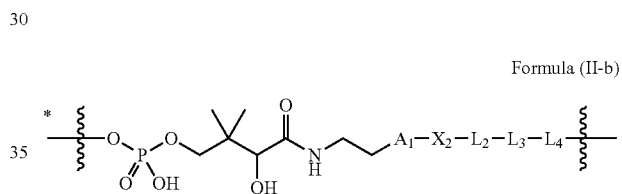

where $A_1$, $X_2$, $L_2$, $L_3$ and $L_4$ are as defined herein and the * denotes that the modified 4'-phosphopantetheinyl moiety is attached to the small peptide tag.

Another embodiment of the Three-Step Method is shown in Scheme (IIIb).

Scheme (IIIb)

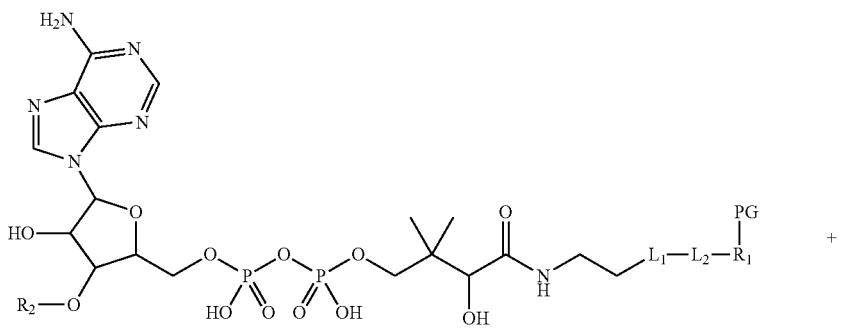

-continued

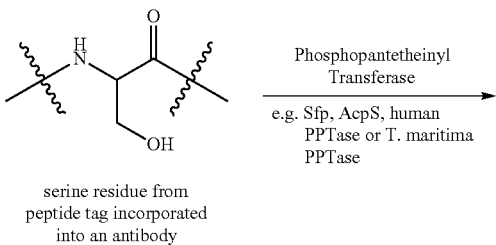

serine residue from
peptide tag incorporated
into an antibody

Phosphopantetheinyl Transferase
e.g. Sfp, AcpS, human PPTase or T. maritima PPTase

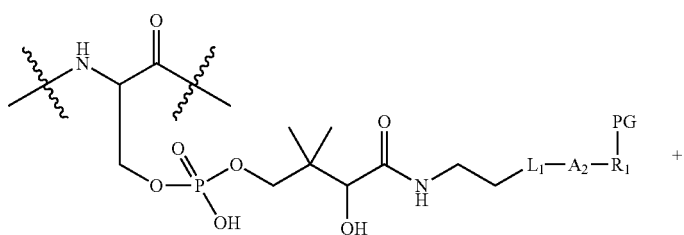

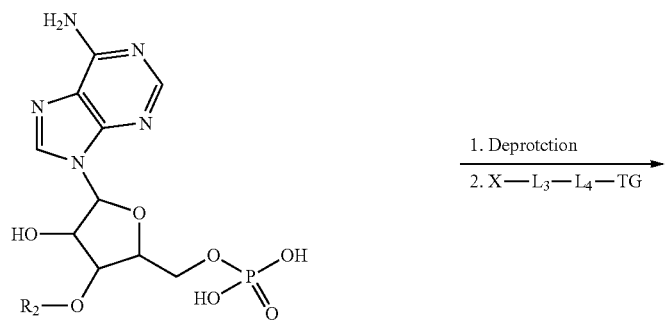

1. Deprotection
2. X—L$_3$—L$_4$—TG

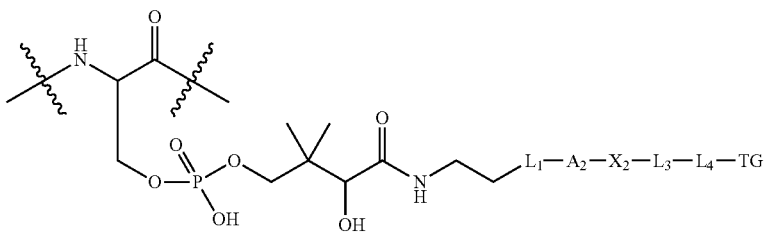

where PG is a protecting group and X, R$_1$, R$_2$, L$_1$, A$_2$, X$_2$, L$_3$, L$_4$ and TG are as defined herein.

The Three-Step Method of Scheme (IIIb) includes the steps of:

(a) providing a modified antibody or antigen binding fragment thereof which has been engineered to contain a short peptide tag, and wherein the peptide tag is a substrate of an enzyme having 4'-phosphopantetheinyl transferase activity;

(b) labeling modified antibody or antigen binding fragment thereof by:

incubating the modified antibody or antigen binding fragment thereof with an enzyme having 4'-phosphopantetheinyl transferase activity in the presence of a compound of Formula (J), Formula (J)

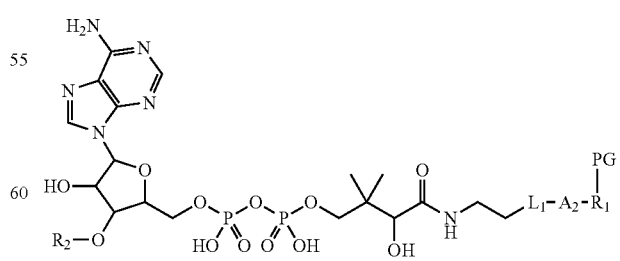

thereby attaching an protected 4'-phosphopantetheinyl group of Formula (I-a) to the short peptide tag;

Formula (J-a)

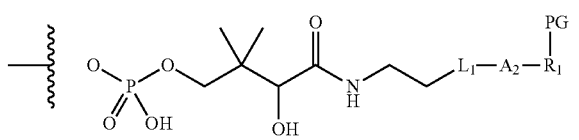

(c) deprotecting the protected 4'-phosphopantetheinyl group to give an activated 4'-phosphopantetheinyl group of Formula (E-a)

Formula (E-a)

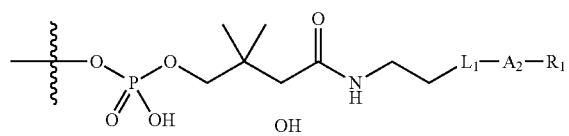

and
(d) reacting the activated 4'-phosphopantetheinyl group with a compound of Formula (II-c):

X-L$_3$-L$_4$-TG      Formula (II-c), where PG is a protecting group and X, R$_1$, R$_2$, L$_1$, A$_2$, L$_3$, L$_4$ and TG are as defined herein.

As a result of the Three-Step Method of Scheme (IIIb) the terminal group is attached to the modified antibody or antigen binding fragment thereof via a linker having the structure according to Formula (II-d):

Formula (II-d)

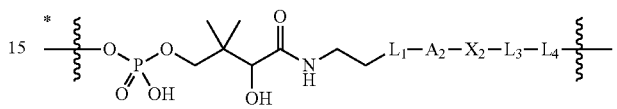

where L$_1$, A$_z$, X$_2$, L$_3$ and L$_4$ are as defined herein and the * denotes that the modified 4'-phosphopantetheinyl moiety is attached to the small peptide tag.

Another embodiment of the Three-Step Method is shown in Scheme (IIIc).

Scheme (IIIc)

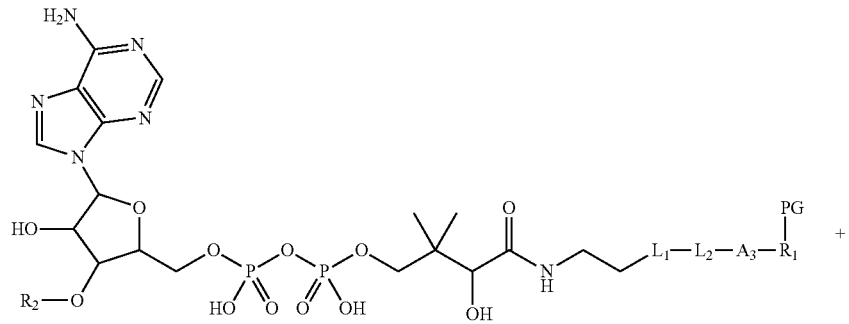

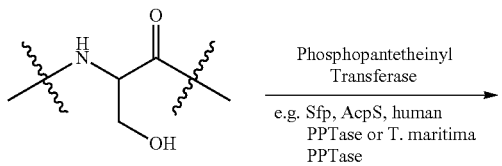

serine residue from peptide tag incorporated into an antibody

Phosphopantetheinyl Transferase
───────────────▶
e.g. Sfp, AcpS, human PPTase or T. maritima PPTase

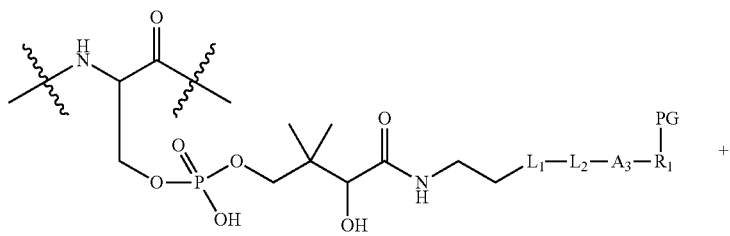

+

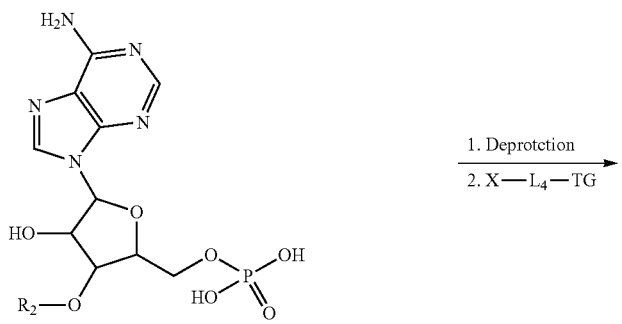

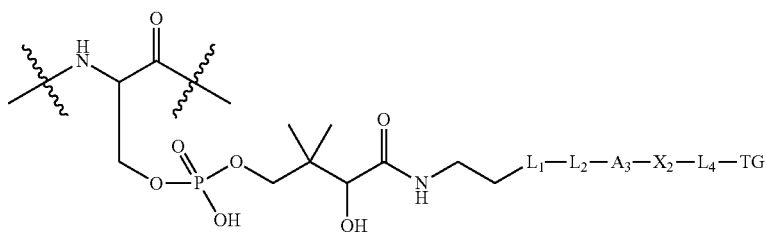

where PG is a protecting group and X, $R_1$, $R_2$, $L_1$, $L_2$, $X_2$, $A_3$, $L_4$ and TG are as defined herein.

The Three-Step Method of Scheme (IIIc) includes the steps of:
(a) providing a modified antibody or antigen binding fragment thereof which has been engineered to contain a short peptide tag, and wherein the peptide tag is a substrate of an enzyme having 4'-phosphopantetheinyl transferase activity;
(b) labeling the modified antibody or antigen binding fragment thereof by:
  incubating the modified antibody or antigen binding fragment thereof with an enzyme having 4'-phosphopantetheinyl transferase activity in the presence of a compound of Formula (K), thereby attaching an protected 4'-phosphopantetheinyl group of Formula (K-a) to the short peptide tag;

Formula (K-a)

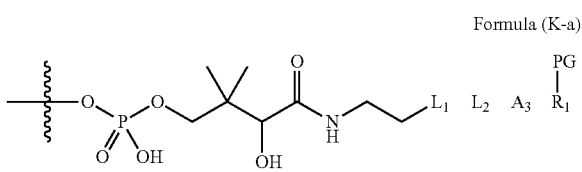

Formula (K)

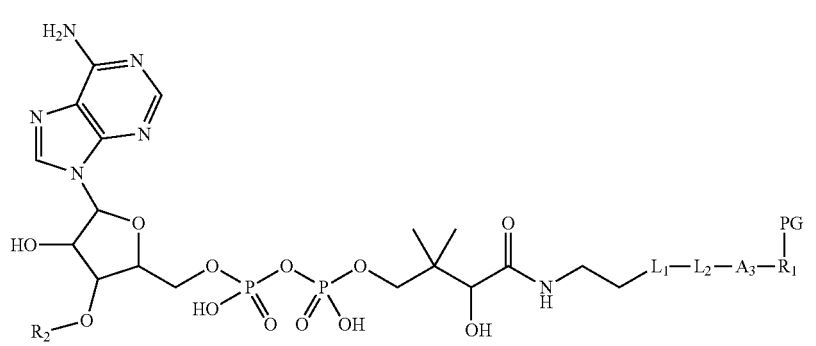

(c) deprotecting the protected 4'-phosphopantetheinyl group to give an activated 4'-phosphopantetheinyl group of Formula (F-a)

Formula (F-a)

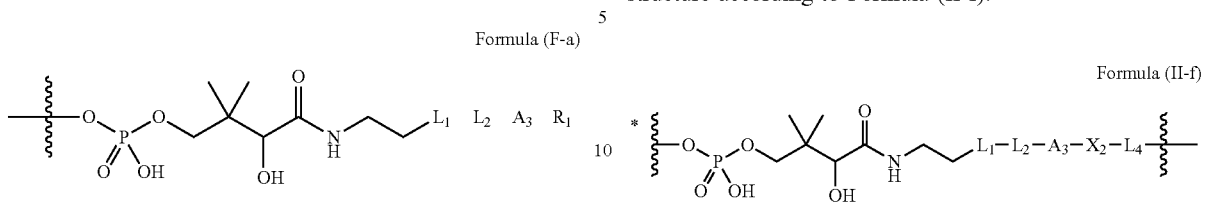

and (d) reacting the activated 4'-phosphopantetheinyl group with a compound of Formula (IIe):

X-L$_4$-TG  Formula (II-e), where PG is a protecting group and X, R$_1$, R$_2$, L$_1$, L$_2$, L$_3$, L$_4$ and TG are as defined herein.

As a result of the Two-Step Method of Scheme (IIIc) the terminal group is attached to the modified antibody or antigen binding fragment thereof via a linker having the structure according to Formula (II-f):

Formula (II-f)

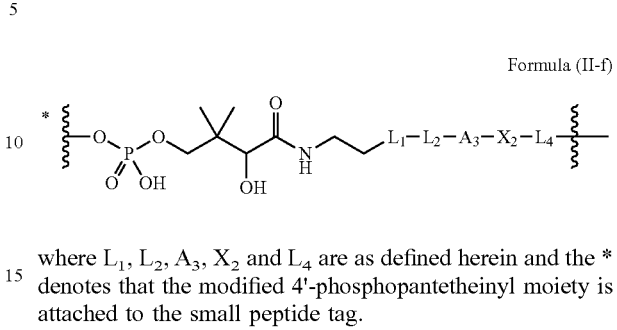

where L$_1$, L$_2$, A$_3$, X$_2$ and L$_4$ are as defined herein and the * denotes that the modified 4'-phosphopantetheinyl moiety is attached to the small peptide tag.

Another embodiment of the Three-Step Method is shown in Scheme (IIId).

Scheme (IIId)

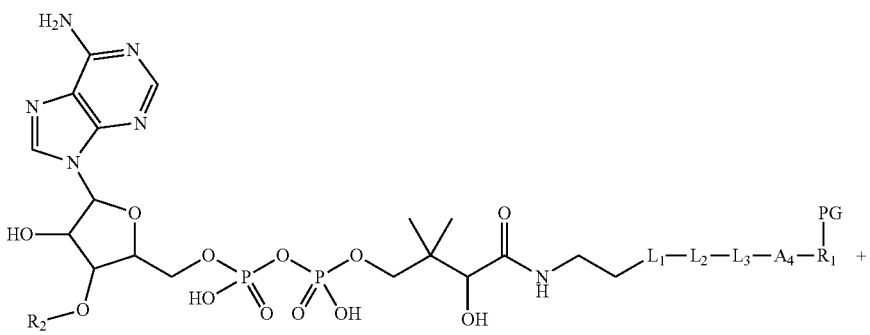

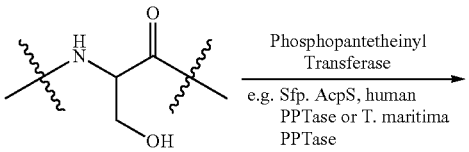

serine residue from peptide tag incorporated into an antibody

Phosphopantetheinyl Transferase
e.g. Sfp. AcpS, human PPTase or T. maritima PPTase

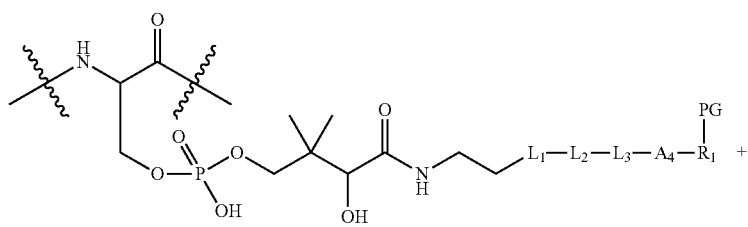

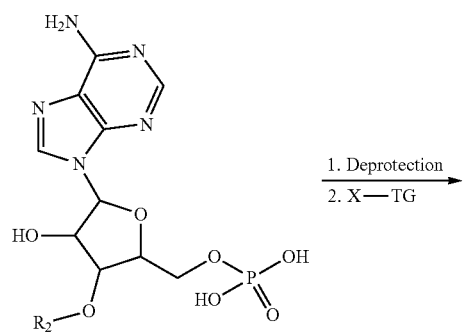

1. Deprotection
2. X—TG

-continued

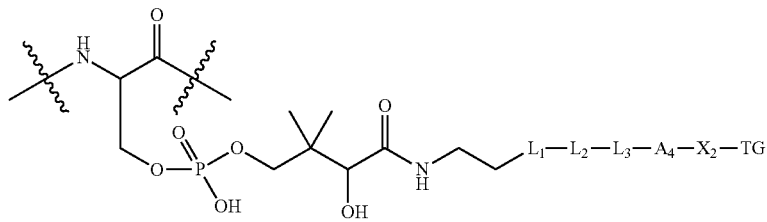

where PG is a protecting group and X, $R_1$, $R_2$, $L_1$, $L_2$, $L_3$, $A_4$, $X_2$ and TG are as defined herein.

The Three-Step Method of Scheme (IIId) includes the steps of:
- (a) providing a modified antibody or antigen binding fragment thereof which has been engineered to contain a short peptide tag, and wherein the peptide tag is a substrate of an enzyme having 4'-phosphopantetheinyl transferase activity;
- (b) labeling the modified antibody or antigen binding fragment thereof by:
  incubating the modified antibody or antigen binding fragment thereof with an enzyme having 4'-phosphopantetheinyl transferase activity in the presence of a compound of Formula (L), thereby attaching an activated 4'-phosphopantetheinyl of Formula (L-a) to the short peptide tag;

Formula (L-a)

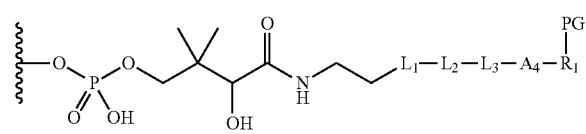

- (c) deprotecting the protected 4'-phosphopantetheinyl group to give an activated 4'-phosphopantetheinyl group of Formula (G-a)

Formula (G-a)

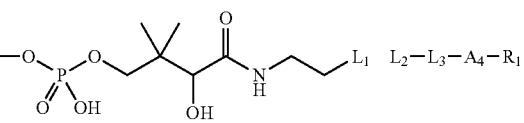

and
- (d) reacting the activated 4'-phosphopantetheinyl group with a compound of Formula (II-g):

X-TG      Formula (II-g), where PG is a protecting group X, $R_1$, $R_2$, $L_1$, $L_2$, $L_3$, $L_4$ and TG are as defined herein.

As a result of the Three-Step Method of Scheme (IIId) the terminal group is attached to the modified antibody or antigen binding fragment thereof via a linker having the structure according to Formula (II-h):

Formula (L)

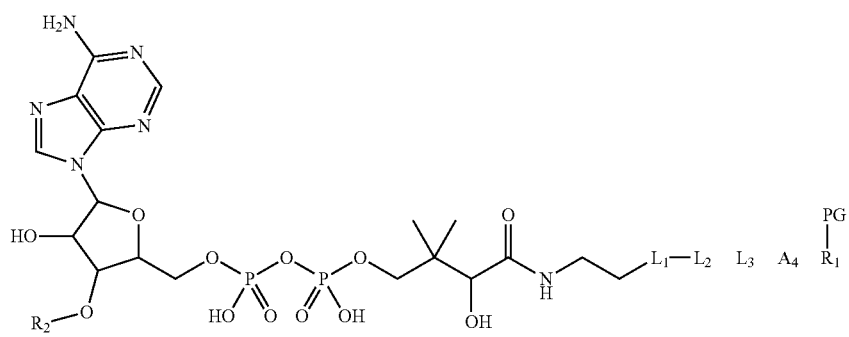

Formula (II-h)

where $L_1$, $L_2$, $L_3$, $A_4$ and $X_2$ are as defined herein and the * denotes that the modified 4'-phosphopantetheinyl moiety is attached to the small peptide tag.

Scheme (IIIe) shows a certain embodiment of the Three-Step Method where the modified antibodies or antigen binding fragment thereof provided herein are site-specifically labeled by a CoA analogue where the thiol of the 4'-phosphopantetheinyl prosthetic group is protected. In step 1 the protected CoA analogue reacts with the conserved serine of the short peptide tag engineered into the antibody thereby attaching the prosthetic group containing the protected thiol to the short peptide tag through the formation of a phosphodiester bond with the hydroxyl group of the conserved serine residue of the short peptide tag. In the second step the thiol protecting group is removed and the resulting modified antibody or antigen binding fragment thereof having a pendant 4'-phosphopantetheinyl group is reacted with a thiol reactive group linked to a terminal group (TG).

Scheme (IIIe)

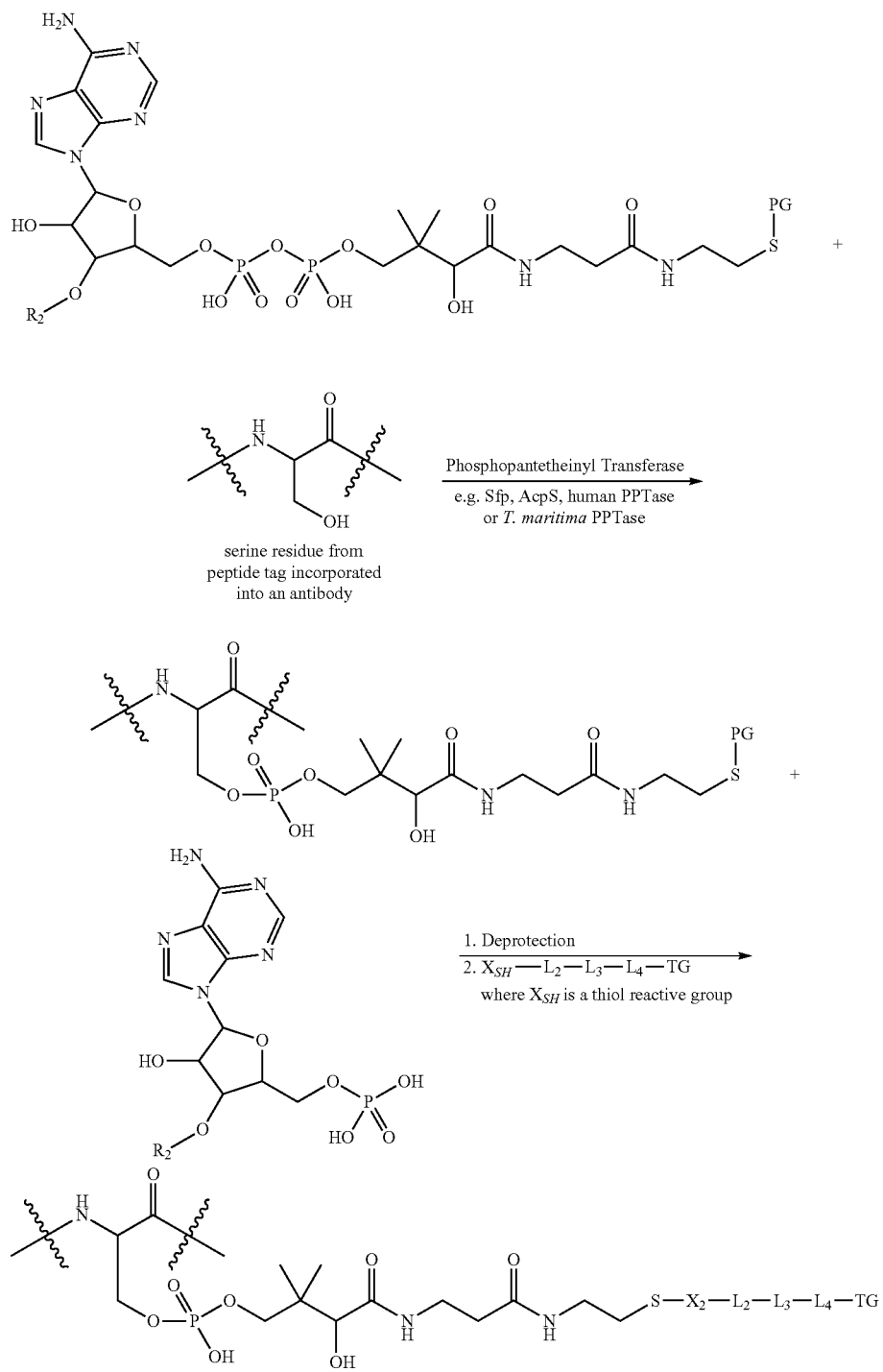

where $X_{SH}$, protecting group (PG), $R_2$, $A_2$, $L_3$, $L_4$ and TG are as defined herein.

Scheme (IIIf) shows a certain embodiment of the Three-Step Method where the modified antibodies or antigen binding fragment thereof provided herein are site-specifically labeled using a CoA where the thiol of the 4'-phosphopantetheinyl prosthetic group is protected. In step 1 the protected CoA reacts with the conserved serine of the short peptide tag engineered into the antibody thereby attaching the prosthetic group containing the protected thiol to the short peptide tag through the formation of a phosphodiester bond with the hydroxyl group of the conserved serine residue of the short peptide tag. In the second step the thiol protecting group is removed and the resulting modified antibody or antigen binding fragment thereof having a pendant 4'-phosphopantetheinyl group is reacted with a thiol reactive group linked to a terminal group (TG).

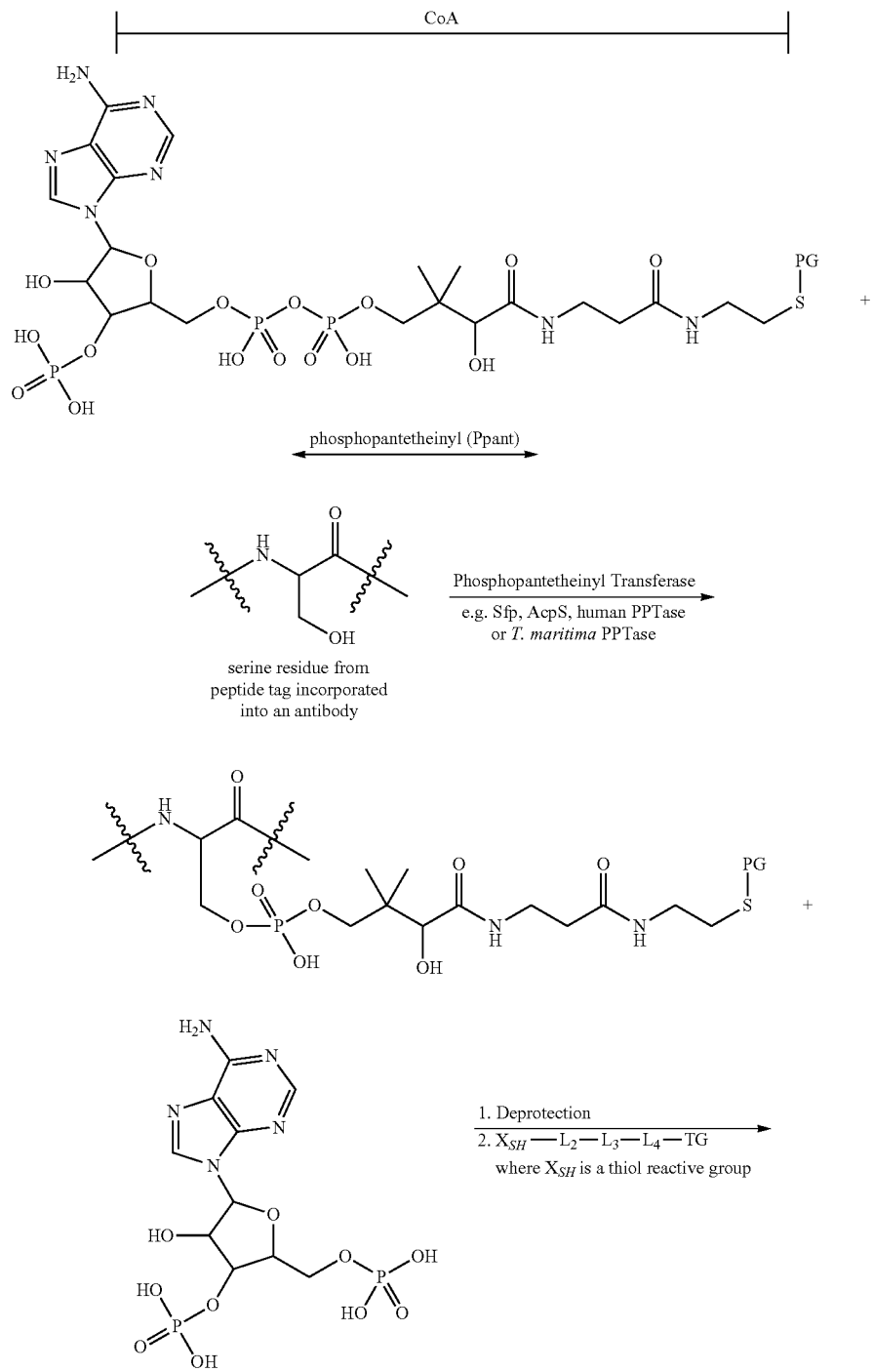

Scheme (IIIf)

-continued

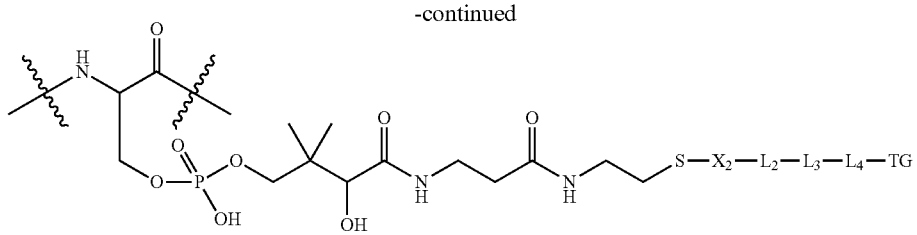

where $X_{SH}$, protecting group (PG), $R_2$, $A_2$, $L_3$, $L_4$ and TG are as defined herein.

In the Three-Step Method of Scheme (IIIe) and Scheme (IIIf), the thiol protecting group includes, but is not limited to, acetyl, acetamidomethyl, benzyl, 4-methylbenzyl, 4-methoxybenzyl, trityl, methoxytrityl, t-butyl, t-butylthiol and 3-nitro-2-pyridinesulphenyl. The thiol reactive group of Scheme (IIIe) and Scheme (IIIf) includes, but is not limited to, maleimide, a haloacetyl, a haloacetamide, a pyridyldisulfide and a vinyl sulfone.

The Three-Step Method of Scheme (IIIf) includes the steps of:
 (a) providing a modified antibody or antigen binding fragment thereof which has been engineered to contain a short peptide tag, and wherein the peptide tag is a substrate of an enzyme having 4'-phosphopantetheinyl transferase activity;
 (b) labeling the modified antibody or antigen binding fragment thereof by:
  (i) incubating the modified antibody or antigen binding fragment thereof with an enzyme having 4'-phosphopantetheinyl transferase activity in the presence of a thiol protected coenzyme A, thereby attaching the thiol protected prosthetic group of coenzyme A to the short peptide tag;
  (ii) deprotecting the thiol group thereby forming a 4'-phosphopantetheinyl group having a pendant thiol, and
  (iii) reacting the pendant thiol of the 4'-phosphopantetheinyl group with a compound of Formula (IIIf):

$X_{SH}$-$L_2$-$L_3$-$L_4$-TG          Formula (IIIf).

where $X_{SH}$ is a thiol reactive group including, but not limited to, a maleimide, a haloacetyl, a haloacetamide, a pyridyldisulfide and a vinyl sulfone. $A_2$, $L_3$, $L_4$ and TG are as defined herein. In addition, in the Two-Step Method of Scheme (IIf) the terminal group is attached to the modified antibody or antigen binding fragment thereof via a linker having the structure according to Formula (III-a):

The * denotes the 4'-phosphopantetheinyl moiety is attached to the small peptide tag and $L_2$, $L_3$, $L_4$ and TG are as defined herein. In this embodiment $X_2$ is a group formed by reaction of $X_{SH}$ and the pendant thiol, including, but not limited to,

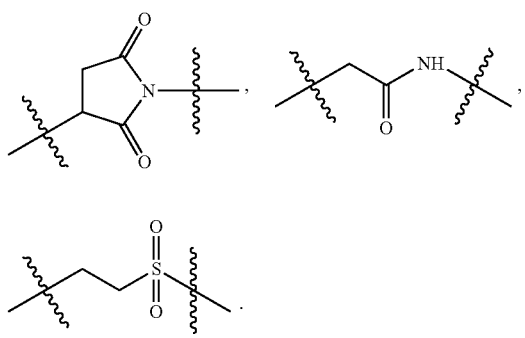 [SMILES: *C1CC(=O)N(*)C1=O ; "," ; *CC(=O)N* ; "," ; *CCS(*)(=O)=O ; "."]

and —S—S—.

In certain embodiments $X_{SH}$-$L_2$-$L_3$-$L_4$-TG is wherein:

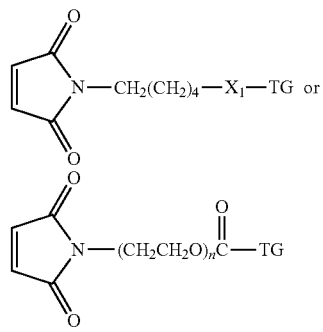

$X_1$ is a bond, —C(═O)—, —NH—, —NHC(═O)—, —(C(═O)NH(CH$_2$)$_n$)$_m$—,

Formula (III-a)

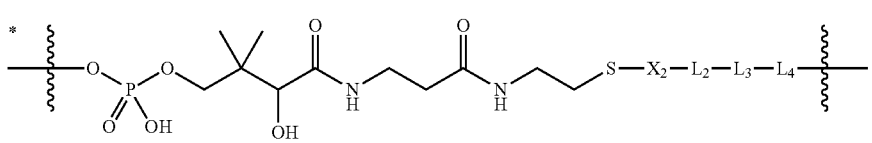

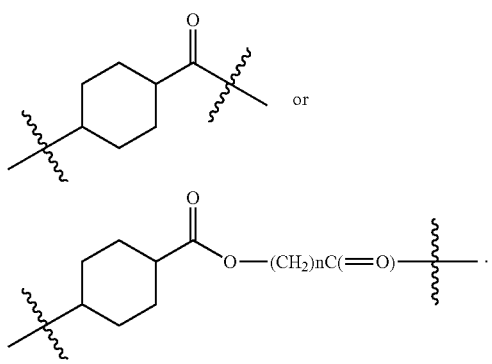

In other embodiments $X_{SH}$-$L_2$-$L_3$-$L_4$-TG is

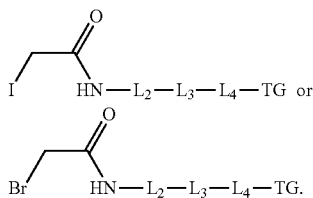

In certain embodiments of the Three-Step Methods described herein, the modified antibody or antigen binding fragment thereof is contacted with a compound having the structure of Formula (H), Formula (J), Formula (K) or Formula (L) and a 4'-phosphopantetheinyl transferase enzyme that is co-expressed in the same cell as the expressed modified antibody or antigen binding fragment thereof. In certain embodiments of the Two-Step Methods described herein, the modified antibody or antigen binding fragment thereof is contacted in the cell culture media with a compound having the structure of Formula (H), Formula (J), Formula (K) or Formula (L) and 4'-phosphopantetheinyl transferase enzyme co-expressed by the same or another cell. In certain embodiments of the Two-Step Methods described herein, the 4'-phosphopantetheinyl transferase enzyme is immobilized on solid support. In certain embodiments the solid support is optionally comprised of a polymer on a bead or a column.

In certain embodiments of the Three-Step Method, the modified antibody or antigen binding fragment thereof will be contacted with a 4'-phosphopantetheinyl transferase enzyme that is coexpressed in the same cell. In certain embodiments of the Three-Step Method, the thiol protected coenzyme A is acetyl-coenzyme A. In certain embodiments of the Three-Step Method, the modified antibody or antigen binding fragment thereof is contacted in the cell culture media with the thiol protected coenzyme A and a 4'-phosphopantetheinyl transferase enzyme co-expressed by the same or another cell. In certain embodiments of the Three-Step Method, the 4'-phosphopantetheinyl transferase enzyme is immobilized on solid support. The solid support is optionally comprised of a polymer on a bead or a column.

In certain embodiments of the One-Step Method, Two-Step Methods or the Three-Step Methods described herein, the modified antibody or antigen binding fragment thereof is contacted, depending on the Method used, with a compound having the structure of Formula (A), Formula (B), Formula (C), Formula (D), Formula (E), Formula (F), Formula (G), Formula (H), Formula (J), Formula (K) or Formula (L) and a 4'-phosphopantetheinyl transferase enzyme at temperatures between 0 and 37 degree Celsius in buffer or media adjusted to pH values between 3 and 10, preferably between 7 and 9 and most preferably around 8, for reaction times between 5 mins and 48 hours.

In certain embodiments of the One-Step Method, Two-Step Methods or the Three-Step Methods described herein, the modified antibody or antigen binding fragment thereof is contacted, depending on the Method used, with a compound having the structure of Formula (A), Formula (B), Formula (C), Formula (D), Formula (E), Formula (F), Formula (G), Formula (H), Formula (J), Formula (K) or Formula (L) in the presence of 4'-phosphopantetheinyl transferase in solution. In other embodiments of the One-Step Method, Two-Step Methods or the Three-Step Methods described herein, the modified antibody or antigen binding fragment thereof is contacted, depending on the Method used, with a compound having the structure of Formula (A), Formula (B), Formula (C), Formula (D), Formula (E), Formula (F), Formula (G), Formula (H), Formula (J), Formula (K) or Formula (L) in the presence of 4'-phosphopantetheinyl transferase in cell media. In certain embodiments of the One-Step Method, Two-Step Methods or the Three-Step Methods described herein, the modified antibody or antigen binding fragment thereof is contacted, depending on the Method used, with a compound having the structure of Formula (A), Formula (B), Formula (C), Formula (D), Formula (E), Formula (F), Formula (G), Formula (H), Formula (J), Formula (K) or Formula (L) in the presence of 4'-phosphopantetheinyl transferase inside a cell.

In certain embodiments of the One-Step Method, Two-Step Methods or the Three-Step Methods described herein, the modified antibody or antigen binding fragment thereof is contacted, depending on the Method used, with a compound having the structure of Formula (A), Formula (B), Formula (C), Formula (D), Formula (E), Formula (F), Formula (G), Formula (H), Formula (J), Formula (K) or Formula (L) in the presence of 4'-phosphopantetheinyl transferase, wherein the 4'-phosphopantetheinyl transferase is immobilized on a surface. In certain embodiments the surface is polymer bead.

In certain embodiments of the One-Step Method, Two-Step Methods or the Three-Step Methods described herein, the modified antibody or antigen binding fragment thereof is contacted, depending on the Method used, with a compound having the structure of Formula (A), Formula (B), Formula (C), Formula (D), Formula (E), Formula (F), Formula (G), Formula (H), Formula (J), Formula (K) or Formula (L) in the presence of 4'-phosphopantetheinyl transferase, wherein the modified antibody or antigen binding fragment thereof is immobilized on a surface. In certain embodiments the surface is polymer bead.

In certain embodiments, the modified antibody or antigen binding fragment thereof provided herein are labeled with a terminal group ("TG")-to-antibody ratio of 1, 2, 3, 4, 5, 6, 7, or 8, wherein the modified antibody or antigen binding fragment thereof contains 1, 2, 3, 4, 5, 6, 7, or 8 short peptide tags located in the structural loop of the antibody and where the short peptide tags are substrates of Sfp 4'-phosphopantetheinyl transferase, AcpS 4'-phosphopantetheinyl transferase, *T. maritima* 4'-phosphopantetheinyl transferase, *C. thermocellum* 4'-phosphopantetheinyl transferase, human 4'-phosphopantetheinyl transferase, or a mutant form thereof. For example, a TG-to-antibody ratio of 4 is achieved by conjugating the terminal group to four copies of inserted S6 tags, or to four copies of inserted ybbR tags or to four copies of inserted A1 tags, or to a combination of two copies of inserted S6 tags and two copies of inserted ybbR tags. In certain embodiments, the modified antibodies or antigen binding fragment thereof provided herein are labeled with two different terminal groups using two different peptide tags and two different 4'-phosphopantetheinyl transferases. By way of example, two copies of the A1 tag are conjugated to a first terminal group using the AcpS 4'-phosphopantetheinyl transferase. Then a second terminal group is attached to two copies of an S6 tag using the Sfp 4'-phosphopantetheinyl transferase (see, e.g., Zhou et al., ACS Chem. Biol. 2:337-346, 2007).

In certain embodiments, the modified antibodies or antigen binding fragment thereof provided herein are labeled with a terminal group (TG)-to-antibody ratio (e.g., DAR) of 1, 2, 3, 4, 5, 6, 7, or 8, wherein the modified antibody or antigen binding fragment thereof contains 1, 2, 3, 4, 5, 6, 7, or 8 short peptide tags located in the structural loop of the antibody and where the short peptide tags are substrates of Sfp 4'-phosphopantetheinyl transferase, AcpS 4'-phosphopantetheinyl transferase, *T. maritima* 4'-phosphopantetheinyl transferase, *C. thermocellum* 4'-phosphopantetheinyl transferase, human 4'-phosphopantetheinyl transferase, or a mutant form thereof. For example, a TG-to-antibody ratio of 4 is achieved by conjugating a drug moiety to four copies of inserted S6 tags, or to four copies of inserted ybbR tags, or to four copies of inserted A1 tags, or to a combination of two copies of inserted S6 tags and two copies of inserted ybbR tags. In certain embodiments, the modified antibodies or antigen binding fragment thereof provided herein are labeled with two different drug moieties using two different peptide tags and two different 4'-phosphopantetheinyl transferases. By way of example, two copies of the A1 tag are conjugated to a first drug moiety using the AcpS 4'-phosphopantetheinyl transferase. Then a second drug moiety is attached to two copies of an S6 tag using the Sfp 4'-phosphopantetheinyl transferase (see, e.g., Zhou et al., ACS Chem. Biol. 2:337-346, 2007).

3. Further Alteration of the Framework of Fc Region

The present invention provides site-specific labeled immunoconjugates. The immunoconjugates of the invention may comprise modified antibodies or antigen binding fragments thereof that further comprise modifications to framework residues within $V_H$ and/or $V_L$, e.g. to improve the properties of the antibody. Typically such framework modifications are made to decrease the immunogenicity of the antibody. For example, one approach is to "back-mutate" one or more framework residues to the corresponding germline sequence. More specifically, an antibody that has undergone somatic mutation may contain framework residues that differ from the germline sequence from which the antibody is derived. Such residues can be identified by comparing the antibody framework sequences to the germline sequences from which the antibody is derived. To return the framework region sequences to their germline configuration, the somatic mutations can be "back-mutated" to the germline sequence by, for example, site-directed mutagenesis. Such "back-mutated" antibodies are also intended to be encompassed by the invention.

Another type of framework modification involves mutating one or more residues within the framework region, or even within one or more CDR regions, to remove T-cell epitopes to thereby reduce the potential immunogenicity of the antibody. This approach is also referred to as "deimmunization" and is described in further detail in U.S. Patent Publication No. 20030153043 by Carr et al.

In addition or alternative to modifications made within the framework or CDR regions, antibodies of the invention may be engineered to include modifications within the Fc region, typically to alter one or more functional properties of the antibody, such as serum half-life, complement fixation, Fc receptor binding, and/or antigen-dependent cellular cytotoxicity. Furthermore, an antibody of the invention may be chemically modified (e.g., one or more chemical moieties can be attached to the antibody) or be modified to alter its glycosylation, again to alter one or more functional properties of the antibody. Each of these embodiments is described in further detail below.

In one embodiment, the hinge region of CH1 is modified such that the number of cysteine residues in the hinge region is altered, e.g., increased or decreased. This approach is described further in U.S. Pat. No. 5,677,425 by Bodmer et al. The number of cysteine residues in the hinge region of CH1 is altered to, for example, facilitate assembly of the light and heavy chains or to increase or decrease the stability of the antibody.

In another embodiment, the Fc hinge region of an antibody is mutated to decrease the biological half-life of the antibody. More specifically, one or more amino acid mutations are introduced into the CH2-CH3 domain interface region of the Fc-hinge fragment such that the antibody has impaired Staphylococcyl protein A (SpA) binding relative to native Fc-hinge domain SpA binding. This approach is described in further detail in U.S. Pat. No. 6,165,745 by Ward et al.

In yet other embodiments, the Fc region is altered by replacing at least one amino acid residue with a different amino acid residue to alter the effector functions of the antibody. For example, one or more amino acids can be replaced with a different amino acid residue such that the antibody has an altered affinity for an effector ligand but retains the antigen-binding ability of the parent antibody. The effector ligand to which affinity is altered can be, for example, an Fc receptor or the C1 component of complement. This approach is described in, e.g., U.S. Pat. Nos. 5,624,821 and 5,648,260, both by Winter et al.

In another embodiment, one or more amino acids selected from amino acid residues can be replaced with a different amino acid residue such that the antibody has altered C1q binding and/or reduced or abolished complement dependent cytotoxicity (CDC). This approach is described in, e.g., U.S. Pat. No. 6,194,551 by Idusogie et al.

In another embodiment, one or more amino acid residues are altered to thereby alter the ability of the antibody to fix complement. This approach is described in, e.g., the PCT Publication WO 94/29351 by Bodmer et al. In a specific embodiment, one or more amino acids of an antibody or antigen binding fragment thereof of the present invention are replaced by one or more allotypic amino acid residues, such as those shown in FIG. 4 for the IgG1 subclass and the kappa isotype. Allotypic amino acid residues also include, but are not limited to, the constant region of the heavy chain of the IgG1, IgG2, and IgG3 subclasses as well as the constant region of the light chain of the kappa isotype as described by Jefferis et al., MAbs. 1:332-338 (2009).

In yet another embodiment, the Fc region is modified to increase the ability of the antibody to mediate antibody dependent cellular cytotoxicity (ADCC) and/or to increase the affinity of the antibody for an Fcγ receptor by modifying one or more amino acids. This approach is described in, e.g., the PCT Publication WO 00/42072 by Presta. Moreover, the binding sites on human IgG1 for FcγRI, FcγRII, FcγRIII and FcRn have been mapped and variants with improved binding have been described (see Shields et al, J. Biol. Chem. 276:6591-6604, 2001).

In still another embodiment, the glycosylation of an antibody is modified. For example, an aglycosylated antibody can be made (i.e., the antibody lacks glycosylation). Glycosylation can be altered to, for example, increase the affinity of the antibody for "antigen." Such carbohydrate modifications can be accomplished by, for example, altering one or more sites of glycosylation within the antibody sequence. For example, one or more amino acid substitutions can be made that result in elimination of one or more variable region framework glycosylation sites to thereby eliminate glycosylation at that site. Such aglycosylation may increase the affinity of the antibody for antigen. Such an approach is described in, e.g., U.S. Pat. Nos. 5,714,350 and 6,350,861 by Co et al.

Additionally or alternatively, an antibody can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies of the invention to thereby produce an antibody with altered glycosylation. For example, EP 1,176,195 by Hang et al. describes a cell line with a functionally disrupted FUT8 gene, which encodes a fucosyl transferase, such that antibodies expressed in such a cell line exhibit hypofucosylation. PCT Publication WO 03/035835 by Presta describes a variant CHO cell line, Lec13 cells, with reduced ability to attach fucose to Asn(297)-linked carbohydrates, also resulting in hypofucosylation of antibodies expressed in that host cell (see also Shields et al., (2002) J. Biol. Chem. 277: 26733-26740). PCT Publication WO 99/54342 by Umana et al describes cell lines engineered to express glycoprotein-modifying glycosyl transferases (e.g., beta(1,4)—N acetyl-glucosaminyltransferase III (GnTIII)) such that antibodies expressed in the engineered cell lines exhibit increased bisecting GlcNac structures which results in increased ADCC activity of the antibodies (see also Umana et al., Nat. Biotech. 17:176-180, 1999).

In another embodiment, the antibody is modified to increase its biological half-life. Various approaches are possible. For example, one or more of the following mutations can be introduced: T252L, T254S, T256F, as described in U.S. Pat. No. 6,277,375 to Ward. Alternatively, to increase the biological half-life, the antibody can be altered within the CH1 or $C_L$ region to contain a salvage receptor binding epitope taken from two loops of a CH2 domain of an Fc region of an IgG, as described in U.S. Pat. Nos. 5,869,046 and 6,121,022 by Presta et al.

4. Antibody Conjugates

The present invention provides site-specific labeling methods, modified antibodies and antigen binding fragments thereof, and immunoconjugates prepared accordingly. Using the methods of the invention, a modified antibody or antigen binding fragments thereof can be conjugated to a label, such as a drug moiety, e.g., an anti-cancer agent, an autoimmune treatment agent, an anti-inflammatory agent, an antifungal agent, an antibacterial agent, an anti-parasitic agent, an anti-viral agent, or an anesthetic agent. An antibody or antigen binding fragments can also be conjugated using several identical or different labeling moieties combining the methods of the invention with other conjugation methods.

In certain embodiments, the terminal group of the immunoconjugates of the present invention is selected from a V-ATPase inhibitor, a HSP90 inhibitor, an IAP inhibitor, an mTor inhibitor, a microtubule stabilizer, a microtubule destabilizers, an auristatin, a dolastatin, a maytansinoid, a MetAP (methionine aminopeptidase), an inhibitor of nuclear export of proteins CRM1, a DPPIV inhibitor, proteasome inhibitors, an inhibitors of phosphoryl transfer reactions in mitochondria, a protein synthesis inhibitor, a kinase inhibitor, a CDK2 inhibitor, a CDK9 inhibitor, an EG5 inhibitor, an HDAC inhibitor, a DNA damaging agent, a DNA alkylating agent, a DNA intercalator, a DNA minor groove binder and a DHFR inhibitor.

Further, the modified antibodies or antigen binding fragments of the present invention may be conjugated to a therapeutic moiety or drug moiety that modifies a given biological response. Therapeutic moieties or drug moieties are not to be construed as limited to classical chemical therapeutic agents. For example, the drug moiety may be a protein, peptide, or polypeptide possessing a desired biological activity. Such proteins may include, for example, a toxin such as abrin, ricin A, pseudomonas exotoxin, cholera toxin, or diphtheria toxin, a protein such as tumor necrosis factor, α-interferon, β-interferon, nerve growth factor, platelet derived growth factor, tissue plasminogen activator, a cytokine, an apoptotic agent, an anti-angiogenic agent, or, a biological response modifier such as, for example, a lymphokine.

In one embodiment, the modified antibodies or antigen binding fragments of the present invention are conjugated to a therapeutic moiety, such as a cytotoxin, a drug (e.g., an immunosuppressant) or a radiotoxin. Examples of cytotoxin include but not limited to, taxanes (see, e.g., International (PCT) Patent Application Nos. WO 01/38318 and PCT/US03/02675), DNA-alkylating agents (e.g., CC-1065 analogs), anthracyclines, tubulysin analogs, duocarmycin analogs, auristatin E, auristatin F, maytansinoids, and cytotoxic agents comprising a reactive polyethylene glycol moiety (see, e.g., Sasse et al., J. Antibiot. (Tokyo), 53, 879-85 (2000), Suzawa et al., Bioorg. Med. Chem., 8, 2175-84 (2000), Ichimura et al., J. Antibiot. (Tokyo), 44, 1045-53 (1991), Francisco et al., Blood (2003)(electronic publication prior to print publication), U.S. Pat. Nos. 5,475,092, 6,340, 701, 6,372,738, and 6,436,931, U.S. Patent Application Publication No. 2001/0036923 A1, Pending U.S. patent application Ser. Nos. 10/024,290 and 10/116,053, and International (PCT) Patent Application No. WO 01/49698), taxon, cytochalasin B, gramicidin D, ethidium bromide, emetine, mitomycin, etoposide, tenoposide, vincristine, vinblastine, t. colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Therapeutic agents also include, for example, anti-metabolites (e.g., methotrexate, 6-mercaptopurine, 6-thioguanine, cytarabine, 5-fluorouracil decarbazine), ablating agents (e.g., mechlorethamine, thioepa chloraxnbucil, meiphalan, carmustine (BSNU) and lomustine (CCNU), cyclothosphamide, busulfan, dibromomannitol, streptozotocin, mitomycin C, and cis-dichlorodiamine platinum (II) (DDP) cisplatin, anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine). (See e.g., Seattle Genetics US20090304721).

Other examples of therapeutic cytotoxins that can be conjugated to the modified antibodies or antigen binding fragments of the invention include duocarmycins, calicheamicins, maytansines and auristatins, and derivatives thereof. An example of a calicheamicin antibody conjugate is commercially available (Mylotarg™; Wyeth-Ayerst).

For further discussion of types of cytotoxins, linkers and methods for conjugating therapeutic agents to antibodies, see also Saito et al., (2003) Adv. Drug Deliv. Rev. 55:199-215; Trail et al., (2003) Cancer Immunol. Immunother. 52:328-337; Payne, (2003) Cancer Cell 3:207-212; Allen, (2002) Nat. Rev. Cancer 2:750-763; Pastan and Kreitman, (2002) Curr. Opin. Investig. Drugs 3:1089-1091; Senter and Springer, (2001) Adv. Drug Deliv. Rev. 53:247-264.

According to the present invention, modified antibodies or antigen binding fragments thereof can also be conjugated to a radioactive isotope to generate cytotoxic radiopharmaceuticals, referred to as radioimmunoconjugates. Examples of radioactive isotopes that can be conjugated to antibodies for use diagnostically or therapeutically include, but are not limited to, iodine$^{131}$, indium$^{111}$, yttrium$^{90}$, and lutetium$^{177}$. Methods for preparing radioimmunoconjugates are established in the art. Examples of radioimmunoconjugates are commercially available, including Zevalin™ (DEC Pharmaceuticals) and Bexxar™ (Corixa Pharmaceuticals), and similar methods can be used to prepare radioimmunoconjugates using the antibodies of the invention. In certain embodiments, the macrocyclic chelator is 1,4,7,10-tetraazacyclododecane-N,N',N'',N'''-tetraacetic acid (DOTA) which can be attached to the antibody via a linker molecule. Such linker molecules are commonly known in the art and described in Denardo et al., (1998) Clin Cancer Res. 4(10): 2483-90; Peterson et al., (1999) Bioconjug. Chem. 10(4): 553-7; and Zimmerman et al., (1999) Nucl. Med. Biol. 26(8):943-50, each incorporated by reference in their entireties.

The present invention further provides modified antibodies or antigen binding fragments thereof that specifically bind to an antigen conjugated to a heterologous protein or polypeptide (or fragment thereof, preferably to a polypeptide of at least 10, at least 20, at least 30, at least 40, at least 50, at least 60, at least 70, at least 80, at least 90 or at least 100 amino acids) to generate fusion proteins. In particular, the invention provides fusion proteins comprising an antibody fragment described herein (e.g., a Fab fragment, Fd fragment, Fv fragment, F(ab)2 fragment, a $V_H$ domain, a $V_H$ CDR, a $V_L$ domain or a $V_L$ CDR) and a heterologous protein, polypeptide, or peptide.

Additional fusion proteins may be generated through the techniques of gene-shuffling, motif-shuffling, exon-shuffling, and/or codon-shuffling (collectively referred to as "DNA shuffling"). DNA shuffling may be employed to alter the activities of antibodies of the invention or fragments thereof (e.g., antibodies or fragments thereof with higher affinities and lower dissociation rates). See, generally, U.S. Pat. Nos. 5,605,793, 5,811,238, 5,830,721, 5,834,252, and 5,837,458; Patten et al., (1997) Curr. Opinion Biotechnol. 8:724-33; Harayama, (1998) Trends Biotechnol. 16(2):76-82; Hansson et. al., (1999) J. Mol. Biol. 287:265-76; and Lorenzo and Blasco, (1998) Biotechniques 24(2):308-313 (each of these patents and publications are hereby incorporated by reference in its entirety). Antibodies or fragments thereof, or the encoded antibodies or fragments thereof, may be altered by being subjected to random mutagenesis by error-prone PCR, random nucleotide insertion or other methods prior to recombination. A polynucleotide encoding an antibody or fragment thereof that specifically binds to an antigen may be recombined with one or more components, motifs, sections, parts, domains, fragments, etc. of one or more heterologous molecules.

Moreover, the modified antibodies or antigen binding fragments thereof of the present invention can be conjugated to marker sequences, such as a peptide to facilitate purification. In preferred embodiments, the marker amino acid sequence is a hexa-histidine peptide (SEQ ID NO: 1106), such as the tag provided in a pQE vector (QIAGEN, Inc., 9259 Eton Avenue, Chatsworth, Calif., 91311), among others, many of which are commercially available. As described in Gentz et al., (1989) Proc. Natl. Acad. Sci. USA 86:821-824, for instance, hexa-histidine (SEQ ID NO: 1106) provides for convenient purification of the fusion protein. Other peptide tags useful for purification include, but are not limited to, the hemagglutinin ("HA") tag, which corresponds to an epitope derived from the influenza hemagglutinin protein (Wilson et al., (1984) Cell 37:767), and the "FLAG" tag (A. Einhauer et al., J. Biochem. Biophys. Methods 49: 455-465, 2001). According to the present invention, antibodies or antigen binding fragments can also be conjugated to tumor-penetrating peptides in order to enhance their efficacy.

In other embodiments, modified antibodies or antigen binding fragments of the present invention are conjugated to a diagnostic or detectable agent. Such immunoconjugates can be useful for monitoring or prognosing the onset, development, progression and/or severity of a disease or disorder as part of a clinical testing procedure, such as determining the efficacy of a particular therapy. Such diagnosis and detection can accomplished by coupling the antibody to detectable substances including, but not limited to, various enzymes, such as, but not limited to, horseradish peroxidase, alkaline phosphatase, beta-galactosidase, or acetylcholinesterase; prosthetic groups, such as, but not limited to, streptavidin/biotin and avidin/biotin; fluorescent materials, such as, but not limited to, Alexa Fluor 350, Alexa Fluor 405, Alexa Fluor 430, Alexa Fluor 488, Alexa Fluor 500, Alexa Fluor 514, Alexa Fluor 532, Alexa Fluor 546, Alexa Fluor 555, Alexa Fluor 568, Alexa Fluor 594, Alexa Fluor 610, Alexa Fluor 633, Alexa Fluor 647, Alexa Fluor 660, Alexa Fluor 680, Alexa Fluor 700, Alexa Fluor 750, umbelliferone, fluorescein, fluorescein isothiocyanate, rhodamine, dichlorotriazinylamine fluorescein, dansyl chloride or phycoerythrin; luminescent materials, such as, but not limited to, luminol; bioluminescent materials, such as but not limited to, luciferase, luciferin, and aequorin; radioactive materials, such as, but not limited to, iodine ($^{131}$I, $^{125}$I, $^{123}$I, and $^{121}$I), carbon ($^{14}$C), sulfur ($^{35}$S), tritium ($^{3}$H), indium ($^{151}$In, $^{113}$In, $^{112}$In, and $^{111}$In), technetium ($^{99}$Tc), thallium ($^{201}$Ti), gallium ($^{68}$Ga, $^{67}$Ga), palladium ($^{103}$Pd), molybdenum ($^{99}$Mo), xenon ($^{133}$Xe), fluorine ($^{18}$F), $^{153}$Sm, $^{177}$Lu, $^{159}$Gd, $^{149}$Pm, $^{140}$La, $^{175}$Yb, $^{166}$Ho, $^{90}$Y, 47Sc, $^{186}$Re, $^{188}$Re, $^{142}$Pr, $^{105}$Rh, $^{97}$Ru, $^{68}$Ge, $^{57}$Co, $^{65}$Zn, $^{85}$Sr, $^{32}$P, $^{153}$Gd, $^{169}$Yb, $^{51}$Cr, $^{54}$Mn, $^{75}$Se, $^{64}$Cu, $^{113}$Sn, and $^{117}$Sn; and positron emitting metals using various positron emission tomographies, and non-radioactive paramagnetic metal ions.

Modified antibodies or antigen binding fragments of the invention may also be attached to solid supports, which are particularly useful for immunoassays or purification of the target antigen. Such solid supports include, but are not

5. Pharmaceutical Composition

To prepare pharmaceutical or sterile compositions including immunoconjugates, the immunoconjugates of the invention are mixed with a pharmaceutically acceptable carrier or excipient. The compositions can additionally contain one or more other therapeutic agents that are suitable for treating or preventing cancer (breast cancer, colorectal cancer, lung cancer, multiple myeloma, ovarian cancer, liver cancer, gastric cancer, pancreatic cancer, acute myeloid leukemia, chronic myeloid leukemia, osteosarcoma, squamous cell carcinoma, peripheral nerve sheath tumors schwannoma, head and neck cancer, bladder cancer, esophageal cancer, Barretts esophageal cancer, glioblastoma, clear cell sarcoma of soft tissue, malignant mesothelioma, neurofibromatosis, renal cancer, melanoma, prostate cancer, benign prostatic hyperplasia (BPH), gynacomastica, and endometriosis).

Formulations of therapeutic and diagnostic agents can be prepared by mixing with physiologically acceptable carriers, excipients, or stabilizers in the form of, e.g., lyophilized powders, slurries, aqueous solutions, lotions, or suspensions (see, e.g., Hardman et al., Goodman and Gilman's The Pharmacological Basis of Therapeutics, McGraw-Hill, New York, N.Y., 2001; Gennaro, Remington: The Science and Practice of Pharmacy, Lippincott, Williams, and Wilkins, New York, N.Y., 2000; Avis, et al. (eds.), Pharmaceutical Dosage Forms: Parenteral Medications, Marcel Dekker, NY, 1993; Lieberman, et a (eds.), Pharmaceutical Dosage Forms: Tablets, Marcel Dekker, NY, 1990; Lieberman, et a (eds.) Pharmaceutical Dosage Forms Disperse Systems, Marcel Dekker, NY, 1990; Weiner and Kotkoskie, Excipient Toxicity and Safety, Marcel Dekker, Inc., New York, N.Y., 2000).

Selecting an administration regimen for a therapeutic depends on several factors, including the serum or tissue turnover rate of the entity, the level of symptoms, the immunogenicity of the entity, and the accessibility of the target cells in the biological matrix. In certain embodiments, an administration regimen maximizes the amount of therapeutic delivered to the patient consistent with an acceptable level of side effects. Accordingly, the amount of biologic delivered depends in part on the particular entity and the severity of the condition being treated. Guidance in selecting appropriate doses of antibodies, cytokines, and small molecules are available (see, e.g., Wawrzynczak, Antibody Therapy, Bios Scientific Pub. Ltd, Oxfordshire, UK, 1996; Kresina (ed.), Monoclonal Antibodies, Cytokines and Arthritis, Marcel Dekker, New York, N.Y., 1991; Bach (ed.), Monoclonal Antibodies and Peptide Therapy in Autoimmune Diseases, Marcel Dekker, New York, N.Y., 1993; Baert et at, New Engl. J. Med. 348:601-608, 2003; Milgrom et al., New Engl. J. Med. 341:1966-1973, 1999; Slamon et al., New Engl. J. Med. 344:783-792, 2001; Beniaminovitz et al, New Engl. J. Med. 342:613-619, 2000; Ghosh et al., New Engl. J. Med. 348:24-32, 2003; Lipsky et al., New Engl. J. Med. 343:1594-1602, 2000).

Determination of the appropriate dose is made by the clinician, e.g., using parameters or factors known or suspected in the art to affect treatment or predicted to affect treatment. Generally, the dose begins with an amount somewhat less than the optimum dose and it is increased by small increments thereafter until the desired or optimum effect is achieved relative to any negative side effects. Important diagnostic measures include those of symptoms of, e.g., the inflammation or level of inflammatory cytokines produced.

Actual dosage levels of the active ingredients in the pharmaceutical compositions of the present invention may be varied so as to obtain an amount of the active ingredient which is effective to achieve the desired therapeutic response for a particular patient, composition, and mode of administration, without being toxic to the patient. The selected dosage level will depend upon a variety of pharmacokinetic factors including the activity of the particular compositions of the present invention employed, or the ester, salt or amide thereof, the route of administration, the time of administration, the rate of excretion of the particular compound being employed, the duration of the treatment, other drugs, compounds and/or materials used in combination with the particular compositions employed, the age, sex, weight, condition, general health and prior medical history of the patient being treated, and like factors known in the medical arts.

Compositions comprising antibodies or fragments thereof of the invention can be provided by continuous infusion, or by doses at intervals of, e.g., one day, one week, or 1-7 times per week. Doses may be provided intravenously, subcutaneously, topically, orally, nasally, rectally, intramuscular, intracerebrally, or by inhalation. A specific dose protocol is one involving the maximal dose or dose frequency that avoids significant undesirable side effects.

For the immunoconjugates of the invention, the dosage administered to a patient may be 0.0001 mg/kg to 100 mg/kg of the patient's body weight. The dosage may be between 0.0001 mg/kg and 20 mg/kg, 0.0001 mg/kg and 10 mg/kg, 0.0001 mg/kg and 5 mg/kg, 0.0001 and 2 mg/kg, 0.0001 and 1 mg/kg, 0.0001 mg/kg and 0.75 mg/kg, 0.0001 mg/kg and 0.5 mg/kg, 0.0001 mg/kg to 0.25 mg/kg, 0.0001 to 0.15 mg/kg, 0.0001 to 0.10 mg/kg, 0.001 to 0.5 mg/kg, 0.01 to 0.25 mg/kg or 0.01 to 0.10 mg/kg of the patient's body weight. The dosage of the antibodies or fragments thereof of the invention may be calculated using the patient's weight in kilograms (kg) multiplied by the dose to be administered in mg/kg.

Doses of the immunoconjugates the invention may be repeated and the administrations may be separated by at least 1 day, 2 days, 3 days, 5 days, 10 days, 15 days, 30 days, 45 days, 2 months, 75 days, 3 months, or at least 6 months. In a specific embodiment, does of the immunoconjugates of the invention are repeated every 3 weeks.

An effective amount for a particular patient may vary depending on factors such as the condition being treated, the overall health of the patient, the method route and dose of administration and the severity of side effects (see, e.g., Maynard et al., A Handbook of SOPs for Good Clinical Practice, Interpharm Press, Boca Raton, Fla., 1996; Dent, Good Laboratory and Good Clinical Practice, Urch Publ., London, UK, 2001).

The route of administration may be by, e.g., topical or cutaneous application, injection or infusion by intravenous, intraperitoneal, intracerebral, intramuscular, intraocular, intraarterial, intracerebrospinal, intralesional, or by sustained release systems or an implant (see, e.g., Sidman et al., Biopolymers 22:547-556, 1983; Langer et al., J. Biomed. Mater. Res. 15:167-277, 1981; Langer, Chem. Tech. 12:98-105, 1982; Epstein et al., Proc. Natl. Acad. Sci. USA 82:3688-3692, 1985; Hwang et al., Proc. Natl. Acad. Sci. USA 77:4030-4034, 1980; U.S. Pat. Nos. 6,350,466 and 6,316,024). Where necessary, the composition may also include a solubilizing agent and a local anesthetic such as lidocaine to ease pain at the site of the injection. In addition, pulmonary administration can also be employed, e.g., by use of an inhaler or nebulizer, and formulation with an aerosolizing agent. See, e.g., U.S. Pat. Nos. 6,019,968, 5,985,320, 5,985,309, 5,934,272, 5,874,064, 5,855,913, 5,290,540, and 4,880,078; and PCT Publication Nos. WO 92/19244, WO 97/32572, WO 97/44013, WO 98/31346, and WO 99/66903, each of which is incorporated herein by reference their entirety.

A composition of the present invention may also be administered via one or more routes of administration using one or more of a variety of methods known in the art. As will be appreciated by the skilled artisan, the route and/or mode of administration will vary depending upon the desired results. Selected routes of administration for the immunoconjugates of the invention include intravenous, intramuscular, intradermal, intraperitoneal, subcutaneous, spinal or other parenteral routes of administration, for example by injection or infusion. Parenteral administration may represent modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion. Alternatively, a composition of the invention can be administered via a non-parenteral route, such as a topical, epidermal or mucosal route of administration, for example, intranasally, orally, vaginally, rectally, sublingually or topically. In one embodiment, the immunoconjugates of the invention is administered by infusion. In another embodiment, the immunoconjugates of the invention is administered subcutaneously.

If the immunoconjugates of the invention are administered in a controlled release or sustained release system, a pump may be used to achieve controlled or sustained release (see Langer, supra; Sefton, CRC Crit. Ref Biomed. Eng. 14:20, 1987; Buchwald et al., Surgery 88:507, 1980; Saudek et al., N. Engl. J. Med. 321:574, 1989). Polymeric materials can be used to achieve controlled or sustained release of the therapies of the invention (see e.g., Medical Applications of Controlled Release, Langer and Wise (eds.), CRC Pres., Boca Raton, Fla., 1974; Controlled Drug Bioavailability, Drug Product Design and Performance, Smolen and Ball (eds.), Wiley, New York, 1984; Ranger and Peppas, J. Macromol. Sci. Rev. Macromol. Chem. 23:61, 1983; see also Levy et al., Science 228:190, 1985; During et al., Ann. Neurol. 25:351, 1989; Howard et al., J. Neurosurg. 7 1:105, 1989; U.S. Pat. No. 5,679,377; U.S. Pat. No. 5,916,597; U.S. Pat. No. 5,912,015; U.S. Pat. No. 5,989,463; U.S. Pat. No. 5,128,326; PCT Publication No. WO 99/15154; and PCT Publication No. WO 99/20253. Examples of polymers used in sustained release formulations include, but are not limited to, poly(2-hydroxy ethyl methacrylate), poly(methyl methacrylate), poly(acrylic acid), poly(ethylene-co-vinyl acetate), poly(methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. In one embodiment, the polymer used in a sustained release formulation is inert, free of leachable impurities, stable on storage, sterile, and biodegradable. A controlled or sustained release system can be placed in proximity of the prophylactic or therapeutic target, thus requiring only a fraction of the systemic dose (see, e.g., Goodson, in Medical Applications of Controlled Release, supra, vol. 2, pp. 115-138, 1984).

Controlled release systems are discussed in the review by Langer, Science 249:1527-1533, 1990). Any technique known to one of skill in the art can be used to produce sustained release formulations comprising one or more immunoconjugates of the invention. See, e.g., U.S. Pat. No. 4,526,938, PCT publication WO 91/05548, PCT publication WO 96/20698, Ning et al., Radiotherapy & Oncology 39:179-189, 1996; Song et al., PDA Journal of Pharmaceutical Science & Technology 50:372-397, 1995; Cleek et a, Pro. Intl. Symp. Control. Rel. Bioact. Mater. 24:853-854, 1997; and Lam et al., Proc. Intl. Symp. Control Rel. Bioact. Mater. 24:759-760, 1997, each of which is incorporated herein by reference in their entirety.

If the immunoconjugates of the invention are administered topically, they can be formulated in the form of an ointment, cream, transdermal patch, lotion, gel, shampoo, spray, aerosol, solution, emulsion, or other form well-known to one of skill in the art. See, e.g., Remington's Pharmaceutical Sciences and Introduction to Pharmaceutical Dosage Forms, 19th ed., Mack Pub. Co., Easton, Pa. (1995). For non-sprayable topical dosage forms, viscous to semi-solid or solid forms comprising a carrier or one or more excipients compatible with topical application and having a dynamic viscosity, in some instances, greater than water are typically employed. Suitable formulations include, without limitation, solutions, suspensions, emulsions, creams, ointments, powders, liniments, salves, and the like, which are, if desired, sterilized or mixed with auxiliary agents (e.g., preservatives, stabilizers, wetting agents, buffers, or salts) for influencing various properties, such as, for example, osmotic pressure. Other suitable topical dosage forms include sprayable aerosol preparations wherein the active ingredient, in some instances, in combination with a solid or liquid inert carrier, is packaged in a mixture with a pressurized volatile (e.g., a gaseous propellant, such as freon) or in a squeeze bottle. Moisturizers or humectants can also be added to pharmaceutical compositions and dosage forms if desired. Examples of such additional ingredients are well-known in the art.

If the compositions comprising the immunoconjugates are administered intranasally, it can be formulated in an aerosol form, spray, mist or in the form of drops. In particular, prophylactic or therapeutic agents for use according to the present invention can be conveniently delivered in the form of an aerosol spray presentation from pressurized packs or a nebuliser, with the use of a suitable propellant (e.g., dichlorodifluoromethane, trichlorofluoromethane, dichlorotetrafluoroethane, carbon dioxide or other suitable gas). In the case of a pressurized aerosol the dosage unit may be determined by providing a valve to deliver a metered amount. Capsules and cartridges (composed of, e.g., gelatin) for use in an inhaler or insufflator may be formulated containing a powder mix of the compound and a suitable powder base such as lactose or starch.

Methods for co-administration or treatment with a second therapeutic agent, e.g., a cytokine, steroid, chemotherapeutic agent, antibiotic, or radiation, are known in the art (see, e.g., Hardman et al., (eds.)(2001) Goodman and Gilman's The Pharmacological Basis of Therapeutics, 10.sup.th ed., McGraw-Hill, New York, N.Y.; Poole and Peterson (eds.) (2001) Pharmacotherapeutics for Advanced Practice: A Practical Approach, Lippincott, Williams & Wilkins, Phila., Pa.; Chabner and Longo (eds.)(2001) Cancer Chemotherapy and Biotherapy, Lippincott, Williams & Wilkins, Phila., Pa.). An effective amount of therapeutic may decrease the symptoms by at least 10%; by at least 20%; at least about 30%; at least 40%, or at least 50%.

Additional therapies (e.g., prophylactic or therapeutic agents), which can be administered in combination with the immunoconjugates of the invention may be administered less than 5 minutes apart, less than 30 minutes apart, 1 hour apart, at about 1 hour apart, at about 1 to about 2 hours apart, at about 2 hours to about 3 hours apart, at about 3 hours to about 4 hours apart, at about 4 hours to about 5 hours apart, at about 5 hours to about 6 hours apart, at about 6 hours to about 7 hours apart, at about 7 hours to about 8 hours apart, at about 8 hours to about 9 hours apart, at about 9 hours to about 10 hours apart, at about 10 hours to about 11 hours apart, at about 11 hours to about 12 hours apart, at about 12 hours to 18 hours apart, 18 hours to 24 hours apart, 24 hours to 36 hours apart, 36 hours to 48 hours apart, 48 hours to 52 hours apart, 52 hours to 60 hours apart, 60 hours to 72 hours apart, 72 hours to 84 hours apart, 84 hours to 96 hours apart, or 96 hours to 120 hours apart from the immunoconjugates of the invention. The two or more therapies may be administered within one same patient visit.

In certain embodiments, the immunoconjugates of the invention can be formulated to ensure proper distribution in vivo. For example, the blood-brain barrier (BBB) excludes many highly hydrophilic compounds. To ensure that the therapeutic compounds of the invention cross the BBB (if desired), they can be formulated, for example, in liposomes. For methods of manufacturing liposomes, see, e.g., U.S. Pat. Nos. 4,522,811; 5,374,548; and 5,399,331. The liposomes may comprise one or more moieties which are selectively transported into specific cells or organs, thus enhance targeted drug delivery (see, e.g., Ranade, (1989) J. Clin. Pharmacol. 29:685). Exemplary targeting moieties include folate or biotin (see, e.g., U.S. Pat. No. 5,416,016 to Low et al.); mannosides (Umezawa et al., (1988) Biochem. Biophys. Res. Commun. 153:1038); antibodies (Bloeman et al., (1995) FEBS Lett. 357:140; Owais et al., (1995) Antimicrob. Agents Chemother. 39:180); surfactant protein A receptor (Briscoe et al., (1995) Am. J. Physiol. 1233:134); p 120 (Schreier et al, (1994) J. Biol. Chem. 269:9090); see also K. Keinanen; M. L. Laukkanen (1994) FEBS Lett. 346:123; J. J. Killion; I. J. Fidler (1994) Immunomethods 4:273.

The invention provides protocols for the administration of pharmaceutical composition comprising immunoconjugates of the invention alone or in combination with other therapies to a subject in need thereof. The therapies (e.g., prophylactic or therapeutic agents) of the combination therapies of the present invention can be administered concomitantly or sequentially to a subject. The therapy (e.g., prophylactic or therapeutic agents) of the combination therapies of the present invention can also be cyclically administered. Cycling therapy involves the administration of a first therapy (e.g., a first prophylactic or therapeutic agent) for a period of time, followed by the administration of a second therapy (e.g., a second prophylactic or therapeutic agent) for a period of time and repeating this sequential administration, i.e., the cycle, in order to reduce the development of resistance to one of the therapies (e.g., agents) to avoid or reduce the side effects of one of the therapies (e.g., agents), and/or to improve, the efficacy of the therapies.

The therapies (e.g., prophylactic or therapeutic agents) of the combination therapies of the invention can be administered to a subject concurrently.

The term "concurrently" is not limited to the administration of therapies (e.g., prophylactic or therapeutic agents) at exactly the same time, but rather it is meant that a pharmaceutical composition comprising antibodies or fragments thereof the invention are administered to a subject in a sequence and within a time interval such that the antibodies of the invention can act together with the other therapy(ies) to provide an increased benefit than if they were administered otherwise. For example, each therapy may be administered to a subject at the same time or sequentially in any order at different points in time; however, if not administered at the same time, they should be administered sufficiently close in time so as to provide the desired therapeutic or prophylactic effect. Each therapy can be administered to a subject separately, in any appropriate form and by any suitable route. In various embodiments, the therapies (e.g., prophylactic or therapeutic agents) are administered to a subject less than 15 minutes, less than 30 minutes, less than 1 hour apart, at about 1 hour apart, at about 1 hour to about 2 hours apart, at about 2 hours to about 3 hours apart, at about 3 hours to about 4 hours apart, at about 4 hours to about 5 hours apart, at about 5 hours to about 6 hours apart, at about 6 hours to about 7 hours apart, at about 7 hours to about 8 hours apart, at about 8 hours to about 9 hours apart, at about 9 hours to about 10 hours apart, at about 10 hours to about 11 hours apart, at about 11 hours to about 12 hours apart, 24 hours apart, 48 hours apart, 72 hours apart, or 1 week apart. In other embodiments, two or more therapies (e.g., prophylactic or therapeutic agents) are administered to a within the same patient visit.

The prophylactic or therapeutic agents of the combination therapies can be administered to a subject in the same pharmaceutical composition. Alternatively, the prophylactic or therapeutic agents of the combination therapies can be administered concurrently to a subject in separate pharmaceutical compositions. The prophylactic or therapeutic agents may be administered to a subject by the same or different routes of administration.

The invention having been fully described, it is further illustrated by the following examples and claims, which are illustrative and are not meant to be further limiting.

EXAMPLES

Example 1

Design of Peptide-Tagged IgG Constructs

Visual inspection of the NMR structure of the 4'-phosphopantetheinyl transferase (PPTase) Sfp (PDB ID: 2GE1, Koglin et al., (2006) Science 312: 273-276) model with a peptide substrate reveals that the reactive Ser residue of the S6 tag is inserted deeply into the enzyme active site and is positioned near the alpha phosphate of coenzyme A. The peptide substrate adopts a helix-kink-loop conformation with the Ser residue at the kink. Based on these observations, several loops on the surface of IgG antibodies were selected. The selection procedure involved the following steps. We first built a Trastuzumab homology model using human IgG1 B12 antibody (PDB ID: 1HZH, Saphire et al., (2001) Science 293: 1155-1159) as a template. Next, the loops with significant content of solvent exposed residues were selected and transformed into S6 tag loops.

To that end, different strategies were exploited: grafting of full-length peptide tag, grafting of truncated peptide tag, and insertions (both truncated and full-length). One example of the grafting of a full-length ybbR tag is exemplified by the mutant anti-hHER2-HC-S132D-K133S-S134L-T135E-S136F-G137I-G138A-T139S-A140K-A141L-L142A (SEQ ID NO:102), while the Trastuzumab anti-hHER2-HC-P189G-S190D-S191-S192L-L193S-G194W-T195L (SEQ ID NO:109) mutant constitutes grafting of a truncated S6 tag. Another variant of the grafting strategy was employed, for example, in mutant anti-hHER2-HC-S190G-S191D-S192-L193-G194S-T195W-Q196L-T197L-RLLN-Y198 (SEQ ID NO:113) wherein residues S190 and S191 were mutated to glycine and aspartic acid, respectively, G194 to serine, T195 to tryptophan, Q196 and T197 to leucine and the truncated S6 tag RLLN (SEQ ID NO: 1060) was inserted between L197 and Y198. Alternatively, both truncated and full-length peptide tags were inserted into loops between antibody residues.

Through out the Example section, the peptide-tagged antibodies are named according to the immunoglobulin heavy or light chain, which contains the grafted or inserted peptide tag. For simplicity, the associated unmodified heavy or light chain is not explicitly mentioned. For example, anti-hHER2-HC-T359-GDSLSWLLRLLN-K360 (SEQ ID NO:121) refers to an IgG1, which comprises the corresponding peptide-tagged heavy chain and the associated unmodified kappa light chain anti-hHER2-LC (SEQ ID NO:1130) with X5=Ala and X6=Val. In contrast, the peptide-tagged mAb2 heavy chain constructs are associated with the unmodified lambda light chain mAb2-LC (SEQ ID NO:25). As another example, anti-hHER2-LC-S76D-S77-L78-EFIASKLA-Q79 (SEQ ID NO:30) refers to an IgG1 antibody containing a peptide-tagged light chain that is associated with the unmodified Ig gamma 1 heavy chain anti-hHER2-HC (SEQ ID NO:1131) with X1=Lys, X2=Asp, X3=Leu, and X4=Ala. In cases where the peptide tag(s) is inserted or grafted into the constant region of the heavy or light chain of an antibody, only sequences of the constant region are given.

In all cases, the peptide tag was mapped on the selected loops in such a way that the reactive Ser residue was at or near the tip of the loop in order to allow a deeper fit into the active site of Sfp enzyme. The complexes between IgG and Sfp enzyme were constructed next and examined for clashes. Those with significant clashes were rejected and the corresponding loops were excluded from the selection.

To systematically insert the S6 and ybbR tag sequences into structural loops of the constant regions of Trastuzumab IgG1, insertion sites were chosen both by visual inspection of the crystal structure of the human IgG1 B12 antibody (PDB ID: 1 HZH) as well as by calculating the solvent-accessible surface area of residues by using the program ICM from MolSoft LLC.

Example 2

Production of Peptide-Tagged IgG Constructs

The heavy and light chains of Trastuzumab IgG1 were transiently expressed in mammalian cells using the pOG expression vector under the control of a CMV promoter. Peptide tags for labeling with 4'-phosphopantetheinyl transferases were incorporated into Trastuzumab IgG1 at various positions by standard molecular biology methods. All primers used for cloning are listed in Table 8.

Cell culture and transfection of HEK293F cells was performed using the PEI method as described previously (see for example Erbacher et al., J Gene Med., 1: 210-222 (1999)). Briefly, HEK293F cells were co-transfected with plasmid DNA encoding the heavy and light chains of Trastuzumab (human kappa isotype). The mammalian cells were cultured in FreeStyle™ 293 Expression Medium at 37° C. under 5% $CO_2$, and were split to $0.7 \times 10^6$ cells/ml one day prior to transfection. Following transfection, the HEK293F cells were cultured for five days before harvest by centrifugation at 2000×g for 30 minutes at 4° C.

The resulting medium supernatant was filtered through a 0.22-μm-pore-size filter. The filtrate was then loaded at a flow rate of about 1 mL/min on a protein A affinity column that was previously equilibrated with 20 column volumes of PBS. After washing the column with 20 column volumes of PBS, the antibody was eluted with 5 column volumes of 0.1 M sodium acetate (pH 3.0). The eluate was immediately neutralized with 10% (v/v) 1 M Tris/HCl (pH 10). Dialysis into PBS was performed using Slide-a-Lyzer dialysis cassettes with 3.5 or 7.0 kDa molecular weight cut-off (Pierce).

The purity of the final product was assessed by SDS-PAGE. Protein yields were determined by either the Bradford method or by ultraviolet spectroscopy at 280 nm using an ND-1000 UV-Vis Spectrophotometer. Protein yields of peptide-tagged Trastuzumab IgGs are listed in Table 9.

TABLE 8

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
|---|---|---|---|
| anti-hHER2-HC-A118-GDSLSWLLRLLN-S119 | 150 | CTGAGCTGGCTGCTGAGACTGCTGAACAGCACCAAGGGCCCCAGCG TCTCAGCAGCCAGCTCAGGCTGTCGCCAGCCGAGGAGACGGTGACCAG | 1061 1062 |
| anti-hHER2-HC-S119-GDSLSWERLLN-T120 | 151 | CTGAGCTGGCTGCTGAGACTGCTGAACACCAAGGGCCCCAGCGTGTTC TCTCAGCAGCCAGCTCAGGCTGTCGCCGCTAGCCGAGGAGACGGTGAC | 1063 1064 |
| anti-hHER2-HC-T120-GDSLSWLLRLLN-K121 | 152 | CTGAGCTGGCTGCTGAGACTGCTGAACAAGGGCCCCAGCGTGTTCCC TCTCAGCAGCCAGCTCAGGCTGTCGCCGGTGCTAGCCGAGGAGACGG | 1065 1066 |
| anti-hHER2-HC-S131-GDSLSWLLRLLN-S132 | 153 | CTGAGCTGGCTGCTGAGACTGCTGAACAGCAAGAGCACCAGCGGCGG TCTCAGCAGCCAGCTCAGGCTGTCGCCGCTGGGGGCCAGGGGGAAC | 1067 1068 |
| anti-hHER2-HC-S132-GDSLSWERLLN-K133 | 154 | CTGAGCTGGCTGCTGAGACTGCTGAACAAGAGCACCAGCGGCGGCAC TCTCAGCAGCCAGCTCAGGCTGTCGCCGCTGCTGGGGGCCAGGGG | 1069 1070 |
| anti-hHER2-HC-K133-GDSLSWLLRLLN-S134 | 155 | CTGAGCTGGCTGCTGAGACTGCTGAACAGCACCAGCGGCGGCACAG TCTCAGCAGCCAGCTCAGGCTGTCGCCCTTGCTGCTGGGGGCCAGG | 1071 1072 |
| anti-hHER2-HC-S134-GDSLSWLLRLLN-T135 | 156 | CTGAGCTGGCTGCTGAGACTGCTGAACACCAGCGGCGGCACAGCC TCTCAGCAGCCAGCTCAGGCTGTCGCCGCTCTTGCTGCTGGGGGCC | 1073 1074 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
|---|---|---|---|
| anti-hHER2-HC-T135-GDSLSWLLRLLN-S136 | 157 | CTGAGCTGGCTGCTGAGACTGCTGAACAGCGGCGGCACAGCCGCC<br>TCTCAGCAGCCAGCTCAGGCTGTCGCCGGTGCTCTTGCTGCTGGGGG | 1075<br>1076 |
| anti-hHER2-HC-S136-GDSLSWLLRLLN-G137 | 158 | CTGAGCTGGCTGCTGAGACTGCTGAACGGCGGCACAGCCGCCCTG<br>TCTCAGCAGCCAGCTCAGGCTGTCGCCGCTGGTGCTCTTGCTGCTGGG | 1077<br>1078 |
| anti-hHER2-HC-G137-GDSLSWLLRLLN-G138 | 159 | CTGAGCTGGCTGCTGAGACTGCTGAACGGCACAGCCGCCCTGGGC<br>TCTCAGCAGCCAGCTCAGGCTGTCGCCGCCGCTGGTGCTCTTGCTGC | 1079<br>1080 |
| anti-hHER2-HC-G138-GDSLSWLLRLLN-T139 | 160 | CTGAGCTGGCTGCTGAGACTGCTGAACACAGCCGCCCTGGGCTGC<br>TCTCAGCAGCCAGCTCAGGCTGTCGCCGCCGCCGCTGGTGCTCTTG | 1081<br>1082 |
| anti-hHER2-HC-E152-GDSLSWLLRLLN-P153 | 161 | CTGAGCTGGCTGCTGAGACTGCTGAACCCCGTGACCGTGTCCTGGAAC<br>TCTCAGCAGCCAGCTCAGGCTGTCGCCCTCGGGGAAGTAGTCCTTCACC | 1083<br>1084 |
| anti-hHER2-HC-P153-GDSLSWLLRLLN-V154 | 162 | CTGAGCTGGCTGCTGAGACTGCTGAACGTGACCGTGTCCTGGAACAGCG<br>TCTCAGCAGCCAGCTCAGGCTGTCGCCGGGCTCGGGGAAGTAGTCCTTC | 1085<br>1086 |
| anti-hHER2-HC-N159-GDSLSWLLRLLN-S160 | 163 | CTGAGCTGGCTGCTGAGACTGCTGAACAGCGGAGCCCTGACCTCCG<br>TCTCAGCAGCCAGCTCAGGCTGTCGCCGTTCCAGGACACGGTCACGGG | 1087<br>1088 |
| anti-hHER2-HC-S160-GDSLSWLLRLLN-G161 | 164 | CTGAGCTGGCTGCTGAGACTGCTGAACGGAGCCCTGACCTCCGGCGTGCAC<br>TCTCAGCAGCCAGCTCAGGCTGTCGCCGCTGTTCCAGGACACGGTCACG | 1089<br>1090 |
| anti-hHER2-HC-G161-GDSLSWLLRLLN-A162 | 165 | CTGAGCTGGCTGCTGAGACTGCTGAACGCCCTGACCTCCGGCGTG<br>TCTCAGCAGCCAGCTCAGGCTGTCGCCCTCCGCTGTTCCAGGACACGG | 1091<br>1092 |
| anti-hHER2-HC-A162-GDSLSWLLRLLN-L163 | 166 | CTGAGCTGGCTGCTGAGACTGCTGAACCTGACCTCCGGCGTGCACAC<br>TCTCAGCAGCCAGCTCAGGCTGTCGCCGGCTCCGCTGTTCCAGGACAC | 1093<br>1094 |
| anti-hHER2-HC-L163-GDSLSWLLRLLN-T164 | 167 | CTGAGCTGGCTGCTGAGACTGCTGAACACCTCCGGCGTGCACACCTTC<br>TCTCAGCAGCCAGCTCAGGCTGTCGCCCAGGGCTCCGCTGTTCCAGG | 389<br>390 |
| anti-hHER2-HC-T164-GDSLSWLLRLLN-S165 | 168 | CTGAGCTGGCTGCTGAGACTGCTGAACTCCGGCGTGCACACCTTCCC<br>TCTCAGCAGCCAGCTCAGGCTGTCGCCGGTCAGGGCTCCGCTGTTCC | 391<br>392 |
| anti-hHER2-HC-S165-GDSLSWLLRLLN-G166 | 169 | CTGAGCTGGCTGCTGAGACTGCTGAACGGCGTGCACACCTTCCCCG<br>TCTCAGCAGCCAGCTCAGGCTGTCGCCGGAGGTCAGGGCTCCGCTG | 393<br>394 |
| anti-hHER2-HC-P171-GDSLSWLLRLLN-A172 | 170 | CTGAGCTGGCTGCTGAGACTGCTGAACGCCGTGCTGCAGAGCAGCG<br>TCTCAGCAGCCAGCTCAGGCTGTCGCCGGGGAAGGTGTGCACGCCG | 395<br>396 |
| anti-hHER2-HC-S176-GDSLSWLLRLLN-S177 | 171 | CTGAGCTGGCTGCTGAGACTGCTGAACAGCGGCCTGTACAGCCTGTCC<br>TCTCAGCAGCCAGCTCAGGCTGTCGCCGCTCTGCAGCACGGCGGG | 397<br>398 |
| anti-hHER2-HC-S177-GDSLSWLLRLLN-G178 | 172 | CTGAGCTGGCTGCTGAGACTGCTGAACGGCCTGTACAGCCTGTCCAGC<br>TCTCAGCAGCCAGCTCAGGCTGTCGCCGCTGCTCTGCAGCACGGCG | 399<br>400 |
| anti-hHER2-HC-P189-GDSLSWLLRLLN-S190 | 173 | CTGAGCTGGCTGCTGAGACTGCTGAACAGCAGCAGCCTGGGCACCC<br>TCTCAGCAGCCAGCTCAGGCTGTCGCCGGGCACTGTCACCACGCTGG | 401<br>402 |
| anti-hHER2-HC-S190-GDSLSWLLRLLN-S191 | 174 | CTGAGCTGGCTGCTGAGACTGCTGAACAGCAGCCTGGGCACCCAGAC<br>TCTCAGCAGCCAGCTCAGGCTGTCGCCGCTGGGCACTGTCACCACGC | 403<br>404 |
| anti-hHER2-HC-S191-GDSLSWLLRLLN-S192 | 175 | CTGAGCTGGCTGCTGAGACTGCTGAACAGCCTGGGCACCCAGACCTAC<br>TCTCAGCAGCCAGCTCAGGCTGTCGCCGCTGCTGGGCACTGTCACCAC | 405<br>406 |
| anti-hHER2-HC-S192-GDSLSWLLRLLN-L193 | 176 | CTGAGCTGGCTGCTGAGACTGCTGAACCTGGGCACCCAGACCTACATC<br>TCTCAGCAGCCAGCTCAGGCTGTCGCCGCTGCTGCTGGGCACTGTCAC | 407<br>408 |
| anti-hHER2-HC-L193-GDSLSWLLRLLN-G194 | 177 | CTGAGCTGGCTGCTGAGACTGCTGAACGGCACCCAGACCTACATCTGC<br>TCTCAGCAGCCAGCTCAGGCTGTCGCCCAGGCTGCTGCTGGGCACTG | 409<br>410 |
| anti-hHER2-HC-G194-GDSLSWLLRLLN-T195 | 178 | CTGAGCTGGCTGCTGAGACTGCTGAACACCCAGACCTACATCTGCAACGTG<br>TCTCAGCAGCCAGCTCAGGCTGTCGCCGCCCAGGCTGCTGCTGGG | 411<br>412 |
| anti-hHER2-HC-P189G-S190D-S191-S192L-L193S-G194W-T195L-LRLLN-Q196 | 110 | CTGAGCTGGCTGCTGAGACTGCTGAACCAGACCTACATCTGCAACGTGAAC<br>TCTCAGCAGCCAGCTCAGGCTGTCGCCGGTGCCCAGGCTGCTGCTG | 413<br>414 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
| --- | --- | --- | --- |
| anti-hHER2-HC-Q196-GDSLSWLLRLLN-T197 | 180 | CTGAGCTGGCTGCTGAGACTGCTGAACACCTACATCTGCAACGTGAACCAC | 415 |
| | | TCTCAGCAGCCAGCTCAGGCTGTCGCCCTGGGTGCCCAGGCTGCTG | 416 |
| anti-hHER2-HC-K205-GDSLSWLLRLLN-P206 | 181 | CTGAGCTGGCTGCTGAGACTGCTGAACCCCAGCAACACCAAGGTGGAC | 417 |
| | | TCTCAGCAGCCAGCTCAGGCTGTCGCCCTTGTGGTTCACGTTGCAGATGTAGG | 418 |
| anti-hHER2-HC-P206-GDSLSWLLRLLN-S207 | 182 | CTGAGCTGGCTGCTGAGACTGCTGAACAGCAACACCAAGGTGGACAAGAAG | 419 |
| | | TCTCAGCAGCCAGCTCAGGCTGTCGCCGGGCTTGTGGTTCACGTTGCAG | 420 |
| anti-hHER2-HC-S207-GDSLSWLLRLLN-N208 | 183 | CTGAGCTGGCTGCTGAGACTGCTGAACAACACCAAGGTGGACAAGAAGTGG | 421 |
| | | TCTCAGCAGCCAGCTCAGGCTGTCGCCGCTGGGCTTGTGGTTCACGTTG | 422 |
| anti-hHER2-HC-P230-GDSLSWLLRLLN-A231 | 184 | CTGAGCTGGCTGCTGAGACTGCTGAACGCCCCAGAGCTGCTGGGC | 423 |
| | | TCTCAGCAGCCAGCTCAGGCTGTCGCCTGGGCAGGGGGGCAGGTG | 424 |
| anti-hHER2-HC-A231-GDSLSWLLRLLN-P232 | 185 | CTGAGCTGGCTGCTGAGACTGCTGAACCCAGAGCTGCTGGGCGGAC | 425 |
| | | TCTCAGCAGCCAGCTCAGGCTGTCGCCGGCTGGGCAGGGGGGC | 426 |
| anti-hHER2-HC-P232-GDSLSWLLRLLN-E233 | 186 | CTGAGCTGGCTGCTGAGACTGCTGAACGAGCTGCTGGGCGGACCC | 427 |
| | | TCTCAGCAGCCAGCTCAGGCTGTCGCCTGGGGCTGGGCAGGGGGG | 428 |
| anti-hHER2-HC-E233-GDSLSWLLRLLN-L234 | 187 | CTGAGCTGGCTGCTGAGACTGCTGAACCTGCTGGGCGGACCCTCC | 429 |
| | | TCTCAGCAGCCAGCTCAGGCTGTCGCCCTCTGGGGCTGGGCAGGG | 430 |
| anti-hHER2-HC-L234-GDSLSWLLRLLN-L235 | 188 | CTGAGCTGGCTGCTGAGACTGCTGAACCTGGGCGGACCCTCCGTG | 431 |
| | | TCTCAGCAGCCAGCTCAGGCTGTCGCCCAGCTCTGGGGCTGGGCAG | 432 |
| anti-hHER2-HC-L235-GDSLSWLLRLLN-G236 | 189 | CTGAGCTGGCTGCTGAGACTGCTGAACGGCGGACCCTCCGTGTTCC | 433 |
| | | TCTCAGCAGCCAGCTCAGGCTGTCGCCCAGCAGCTCTGGGGCTGGG | 434 |
| anti-hHER2-HC-G236-GDSLSWLLRLLN-G237 | 190 | CTGAGCTGGCTGCTGAGACTGCTGAACGGACCCTCCGTGTTCCTGTTCC | 435 |
| | | TCTCAGCAGCCAGCTCAGGCTGTCGCCGCCCAGCAGCTCTGGGGC | 436 |
| anti-hHER2-HC-P244-GDSLSWLLRLLN-P245 | 191 | CTGAGCTGGCTGCTGAGACTGCTGAACCCCAAGCCCAAGGACACCCTG | 437 |
| | | TCTCAGCAGCCAGCTCAGGCTGTCGCCGGGGAACAGGAACACGGAGGG | 438 |
| anti-hHER2-HC-P245-GDSLSWLLRLLN-K246 | 192 | CTGAGCTGGCTGCTGAGACTGCTGAACAAGCCCAAGGACACCCTGATGATC | 439 |
| | | TCTCAGCAGCCAGCTCAGGCTGTCGCCGGGGGGGAACAGGAACACGG | 440 |
| anti-hHER2-HC-I253-GDSLSWLLRLLN-S254 | 193 | CTGAGCTGGCTGCTGAGACTGCTGAACAGCAGGACCCCCGAGGTGAC | 441 |
| | | TCTCAGCAGCCAGCTCAGGCTGTCGCCGATCATCAGGGTGTCCTTGGGC | 442 |
| anti-hHER2-HC-S254-GDSLSWLLRLLN-R255 | 194 | CTGAGCTGGCTGCTGAGACTGCTGAACAGGACCCCCGAGGTGACCTG | 443 |
| | | TCTCAGCAGCCAGCTCAGGCTGTCGCCGCTGATCATCAGGGTGTCCTTGG | 444 |
| anti-hHER2-HC-R255-GDSLSWLLRLLN-T256 | 195 | CTGAGCTGGCTGCTGAGACTGCTGAACACCCCCGAGGTGACCTGCG | 445 |
| | | TCTCAGCAGCCAGCTCAGGCTGTCGCCCCTGCTGATCATCAGGGTGTCC | 446 |
| anti-hHER2-HC-T256-GDSLSWLLRLLN-P257 | 196 | CTGAGCTGGCTGCTGAGACTGCTGAACCCCGAGGTGACCTGCGTGG | 447 |
| | | TCTCAGCAGCCAGCTCAGGCTGTCGCCGGTCCTGCTGATCATCAGGGTG | 448 |
| anti-hHER2-HC-P257-GDSLSWLLRLLN-E258 | 197 | CTGAGCTGGCTGCTGAGACTGCTGAACGAGGTGACCTGCGTGGTGTG | 449 |
| | | TCTCAGCAGCCAGCTCAGGCTGTCGCCGGGGGTCCTGCTGATCATCAG | 450 |
| anti-hHER2-HC-S267-GDSLSWLLRLLN-H268 | 198 | CTGAGCTGGCTGCTGAGACTGCTGAACCACGAGGACCCAGAGGTGAAGTTC | 451 |
| | | TCTCAGCAGCCAGCTCAGGCTGTCGCCGCTCACGTCCACCACCACGC | 452 |
| anti-hHER2-HC-H268-GDSLSWLLRLLN-E269 | 199 | CTGAGCTGGCTGCTGAGACTGCTGAACGAGGACCCAGAGGTGAAGTTCAAC | 453 |
| | | TCTCAGCAGCCAGCTCAGGCTGTCGCCGTGGCTCACGTCCACCACCAC | 454 |
| anti-hHER2-HC-E269-GDSLSWLLRLLN-D270 | 200 | CTGAGCTGGCTGCTGAGACTGCTGAACGACCCAGAGGTGAAGTTCAACTGG | 455 |
| | | TCTCAGCAGCCAGCTCAGGCTGTCGCCCTCGTGGCTCACGTCCACCAC | 456 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
|---|---|---|---|
| anti-hHER2-HC-D270-GDSLSWLLRLLN-P271 | 201 | CTGAGCTGGCTGCTGAGACTGCTGAACCCAGAGGTGAAGTTCAACTGGTAC | 457 |
| | | TCTCAGCAGCCAGCTCAGGCTGTCGCCGTCCTCGTGGCTCACGTCCAC | 458 |
| anti-hHER2-HC-P271-GDSLSWLLRLLN-E272 | 202 | CTGAGCTGGCTGCTGAGACTGCTGAACGAGGTGAAGTTCAACTGGTACGTGG | 459 |
| | | TCTCAGCAGCCAGCTCAGGCTGTCGCCTGGGTCCTCGTGGCTCACGTC | 460 |
| anti-hHER2-HC-D280-GDSLSWLLRLLN-G281 | 203 | CTGAGCTGGCTGCTGAGACTGCTGAACGGCGTGGAGGTGCACAACGC | 461 |
| | | TCTCAGCAGCCAGCTCAGGCTGTCGCCGTCCACGTACCAGTTGAACTTCACC | 462 |
| anti-hHER2-HC-H285-GDSLSWLLRLLN-N286 | 204 | CTGAGCTGGCTGCTGAGACTGCTGAACAACGCCAAGACCAAGCCCAGAG | 463 |
| | | TCTCAGCAGCCAGCTCAGGCTGTCGCCGTGCACCTCCACGCCGTCC | 464 |
| anti-hHER2-HC-N286-GDSLSWLLRLLN-A287 | 205 | CTGAGCTGGCTGCTGAGACTGCTGAACGCCAAGACCAAGCCCAGAGAG | 465 |
| | | TCTCAGCAGCCAGCTCAGGCTGTCGCCGTTGTGCACCTCCACGCCGTC | 466 |
| anti-hHER2-HC-P291-GDSLSWLLRLLN-R292 | 206 | CTGAGCTGGCTGCTGAGACTGCTGAACAGAGAGGAGCAGTACAACAGCACC | 467 |
| | | TCTCAGCAGCCAGCTCAGGCTGTCGCCGGGCTTGGTCTTGGCGTTGTG | 468 |
| anti-hHER2-HC-T307-GDSLSWLLRLLN-V308 | 207 | CTGAGCTGGCTGCTGAGACTGCTGAACGTGCTGCACCAGGACTGGCTG | 469 |
| | | TCTCAGCAGCCAGCTCAGGCTGTCGCCGGTCAGCACGGACACCACCC | 470 |
| anti-hHER2-HC-V308-GDSLSWLLRLLN-L309 | 208 | CTGAGCTGGCTGCTGAGACTGCTGAACCTGCACCAGGACTGGCTGAAC | 471 |
| | | TCTCAGCAGCCAGCTCAGGCTGTCGCCCACGGTCAGCACGGACACCAC | 472 |
| anti-hHER2-HC-L309-GDSLSWLLRLLN-H310 | 209 | CTGAGCTGGCTGCTGAGACTGCTGAACCACCAGGACTGGCTGAACGGC | 473 |
| | | TCTCAGCAGCCAGCTCAGGCTGTCGCCCAGCACGGTCAGCACGGACAC | 474 |
| anti-hHER2-HC-H310-GDSLSWLLRLLN-Q311 | 210 | CTGAGCTGGCTGCTGAGACTGCTGAACCAGGACTGGCTGAACGGCAAG | 475 |
| | | TCTCAGCAGCCAGCTCAGGCTGTCGCCGTGCAGCACGGTCAGCACGG | 476 |
| anti-hHER2-HC-N315-GDSLSWLLRLLN-G316 | 211 | CTGAGCTGGCTGCTGAGACTGCTGAACGGCAAGGAATACAAGTGCAAGGTC | 477 |
| | | TCTCAGCAGCCAGCTCAGGCTGTCGCCGTTCAGCCAGTCCTGGTGCAG | 478 |
| anti-hHER2-HC-G316-GDSLSWLLRLLN-K317 | 212 | CTGAGCTGGCTGCTGAGACTGCTGAACAAGGAATACAAGTGCAAGGTCTCCAAC | 479 |
| | | TCTCAGCAGCCAGCTCAGGCTGTCGCCGCCGTTCAGCCAGTCCTGGTG | 480 |
| anti-hHER2-HC-K317-GDSLSWLLRLLN-E318 | 213 | CTGAGCTGGCTGCTGAGACTGCTGAACGAATACAAGTGCAAGGTCTCCAACAAG | 481 |
| | | TCTCAGCAGCCAGCTCAGGCTGTCGCCCTTGCCGTTCAGCCAGTCCTG | 482 |
| anti-hHER2-HC-K326-GDSLSWLLRLLN-A327 | 214 | CTGAGCTGGCTGCTGAGACTGCTGAACGCCCTGCCAGCCCCCATC | 483 |
| | | TCTCAGCAGCCAGCTCAGGCTGTCGCCCTTGTTGGAGACCTTGCACTTGTATTC | 484 |
| anti-hHER2-HC-A327-GDSLSWLLRLLN-L328 | 215 | CTGAGCTGGCTGCTGAGACTGCTGAACCTGCCAGCCCCCATCGAAAAG | 485 |
| | | TCTCAGCAGCCAGCTCAGGCTGTCGCCGGCCTTGTTGGAGACCTTGCAC | 486 |
| anti-hHER2-HC-L328-GDSLSWLLRLLN-P329 | 216 | CTGAGCTGGCTGCTGAGACTGCTGAACCCAGCCCCCATCGAAAAGACC | 487 |
| | | TCTCAGCAGCCAGCTCAGGCTGTCGCCCAGGGCCTTGTTGGAGACCTTG | 488 |
| anti-hHER2-HC-P329-GDSLSWLLRLLN-A330 | 217 | CTGAGCTGGCTGCTGAGACTGCTGAACGCCCCCATCGAAAAGACCATCAG | 489 |
| | | TCTCAGCAGCCAGCTCAGGCTGTCGCCTGGCAGGGCCTTGTTGGAGAC | 490 |
| anti-hHER2-HC-A330-GDSLSWLLRLLN-P331 | 218 | CTGAGCTGGCTGCTGAGACTGCTGAACCCCATCGAAAAGACCATCAGCAAG | 491 |
| | | TCTCAGCAGCCAGCTCAGGCTGTCGCCGGCTGGCAGGGCCTTGTTGG | 492 |
| anti-hHER2-HC-A339-GDSLSWLLRLLN-K340 | 219 | CTGAGCTGGCTGCTGAGACTGCTGAACAAGGGCCAGCCACGGGAGC | 493 |
| | | TCTCAGCAGCCAGCTCAGGCTGTCGCCGGCCTTGCTGATGGTCTTTTCGATG | 494 |
| anti-hHER2-HC-K340-GDSLSWLLRLLN-G341 | 220 | CTGAGCTGGCTGCTGAGACTGCTGAACGGCCAGCCACGGGAGCCC | 495 |
| | | TCTCAGCAGCCAGCTCAGGCTGTCGCCCTTGGCCTTGCTGATGGTCTTTTC | 496 |
| anti-hHER2-HC-G341-GDSLSWLLRLLN-Q342 | 221 | CTGAGCTGGCTGCTGAGACTGCTGAACCAGCCACGGGAGCCCCAG | 497 |
| | | TCTCAGCAGCCAGCTCAGGCTGTCGCCGCCCTTGGCCTTGCTGATGGTC | 498 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
|---|---|---|---|
| anti-hHER2-HC-Q342-GDSLSWLLRLLN-P343 | 222 | CTGAGCTGGCTGCTGAGACTGCTGAACCCACGGGAGCCCCAGGTG<br>TCTCAGCAGCCAGCTCAGGCTGTCGCCCTGGCCCTTGGCCTTGCTGATG | 499<br>500 |
| anti-hHER2-HC-P343-GDSLSWLLRLLN-R344 | 223 | CTGAGCTGGCTGCTGAGACTGCTGAACCGGGAGCCCCAGGTGTACAC<br>TCTCAGCAGCCAGCTCAGGCTGTCGCCTGGCTGGCCCTTGGCCTTGC | 501<br>502 |
| anti-hHER2-HC-R344-GDSLSWLLRLLN-E345 | 224 | CTGAGCTGGCTGCTGAGACTGCTGAACGAGCCCCAGGTGTACACCCTG<br>TCTCAGCAGCCAGCTCAGGCTGTCGCCCCGTGGCTGGCCCTTGGC | 503<br>504 |
| anti-hHER2-HC-R355-GDSLSWLLRLLN-E356 | 225 | CTGAGCTGGCTGCTGAGACTGCTGAACGAGGAGATGACCAAGAACCAGG<br>TG<br>TCTCAGCAGCCAGCTCAGGCTGTCGCCCCGGGAGGGGGCAGGG | 505<br>506 |
| anti-hHER2-HC-E356-GDSLSWLLRLLN-E357 | 226 | CTGAGCTGGCTGCTGAGACTGCTGAACGAGATGACCAAGAACCAGGTGT<br>CC<br>TCTCAGCAGCCAGCTCAGGCTGTCGCCCTCCCGGGAGGGGGCAG | 507<br>508 |
| anti-hHER2-HC-E357-GDSLSWLLRLLN-M358 | 227 | CTGAGCTGGCTGCTGAGACTGCTGAACATGACCAAGAACCAGGTGTCCCT<br>G<br>TCTCAGCAGCCAGCTCAGGCTGTCGCCCTCCTCCCGGGAGGGGG | 509<br>510 |
| anti-hHER2-HC-M358-GDSLSWLLRLLN-T359 | 228 | CTGAGCTGGCTGCTGAGACTGCTGAACACCAAGAACCAGGTGTCCCTGAC<br>TCTCAGCAGCCAGCTCAGGCTGTCGCCCATCTCCTCCCGGGAGGGG | 511<br>512 |
| anti-hHER2-HC-T359-GDSLSWLLRLLN-K360 | 121 | CTGAGCTGGCTGCTGAGACTGCTGAACAAGAACCAGGTGTCCCTGACCTG<br>TCTCAGCAGCCAGCTCAGGCTGTCGCCGGTCATCTCCTCCCGGGAG | 513<br>514 |
| anti-hHER2-HC-K360-GDSLSWLLRLLN-N361 | 229 | CTGAGCTGGCTGCTGAGACTGCTGAACAACCAGGTGTCCCTGACCTGTC<br>TCTCAGCAGCCAGCTCAGGCTGTCGCCCTTGGTCATCTCCTCCCGGGAG | 515<br>516 |
| anti-hHER2-HC-N384-GDSLSWLLRLLN-G385 | 230 | CTGAGCTGGCTGCTGAGACTGCTGAACGGCCAGCCCGAGAACAACTAC<br>TCTCAGCAGCCAGCTCAGGCTGTCGCCGTTGCTCTCCCACTCCACGGC | 517<br>518 |
| anti-hHER2-HC-E388-GDSLSWLLRLLN-N389 | 127 | CTGAGCTGGCTGCTGAGACTGCTGAACAACAACTACAAGACCACACCTCC<br>AG<br>TCTCAGCAGCCAGCTCAGGCTGTCGCCCTCGGGCTGGCCGTTGCTC | 519<br>520 |
| anti-hHER2-HC-N389-GDSLSWLLRLLN-N390 | 231 | CTGAGCTGGCTGCTGAGACTGCTGAACAACTACAAGACCACACCTCCAGT<br>GC<br>TCTCAGCAGCCAGCTCAGGCTGTCGCCGTTCTCGGGCTGGCCGTTGC | 521<br>522 |
| anti-hHER2-HC-T394-GDSLSWLLRLLN-P395 | 232 | CTGAGCTGGCTGCTGAGACTGCTGAACCCTCCAGTGCTGGACAGCGAC<br>TCTCAGCAGCCAGCTCAGGCTGTCGCCTGTGGTCTTGTAGTTGTTCTCGGG<br>C | 523<br>524 |
| anti-hHER2-HC-P395-GDSLSWLLRLLN-P396 | 233 | CTGAGCTGGCTGCTGAGACTGCTGAACCCAGTGCTGGACAGCGACGG<br>TCTCAGCAGCCAGCTCAGGCTGTCGCCAGGTGTGGTCTTGTAGTTGTTCTC<br>G | 525<br>526 |
| anti-hHER2-HC-D399-GDSLSWLLRLLN-S400 | 234 | CTGAGCTGGCTGCTGAGACTGCTGAACAGCGACGGCAGCTTCTTCCTG<br>TCTCAGCAGCCAGCTCAGGCTGTCGCCGTCCAGCACTGGAGGTGTGGTC | 527<br>528 |
| anti-hHER2-HC-S400-GDSLSWLLRLLN-D401 | 136 | CTGAGCTGGCTGCTGAGACTGCTGAACGACGGCAGCTTCTTCCTGTACAG<br>TCTCAGCAGCCAGCTCAGGCTGTCGCCGCTGTCCAGCACTGGAGGTGTG | 529<br>530 |
| anti-hHER2-HC-D401-GDSLSWLLRLLN-G402 | 235 | CTGAGCTGGCTGCTGAGACTGCTGAACGGCAGCTTCTTCCTGTACAGCAA<br>G<br>TCTCAGCAGCCAGCTCAGGCTGTCGCCGTCGCTGTCCAGCACTGGAGG | 531<br>532 |
| anti-hHER2-HC-S415-GDSLSWLLRLLN-R416 | 236 | CTGAGCTGGCTGCTGAGACTGCTGAACAGGTGGCAGCAGGGCAACGTG<br>TCTCAGCAGCCAGCTCAGGCTGTCGCCGGACTTGTCCACGGTCAGCTTG | 533<br>534 |
| anti-hHER2-HC-R416-GDSLSWLLRLLN-W417 | 237 | CTGAGCTGGCTGCTGAGACTGCTGAACTGGCAGCAGGGCAACGTGTTC<br>TCTCAGCAGCCAGCTCAGGCTGTCGCCCCTGGACTTGTCCACGGTCAG | 535<br>536 |
| anti-hHER2-HC-W417-GDSLSWLLRLLN-Q418 | 238 | CTGAGCTGGCTGCTGAGACTGCTGAACCAGCAGGGCAACGTGTTCAGC<br>TCTCAGCAGCCAGCTCAGGCTGTCGCCCCACCTGGACTTGTCCACGGTC | 537<br>538 |
| anti-hHER2-HC-Q418-GDSLSWLLRLLN-Q419 | 239 | CTGAGCTGGCTGCTGAGACTGCTGAACCAGGGCAACGTGTTCAGCTGC<br>TCTCAGCAGCCAGCTCAGGCTGTCGCCCTGCCACCTGGACTTGTCCAC | 539<br>540 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
|---|---|---|---|
| anti-hHER2-HC-Q419-GDSLSWLLRLLN-G420 | 240 | CTGAGCTGGCTGCTGAGACTGCTGAACGGCAACGTGTTCAGCTGCAGC<br>TCTCAGCAGCCAGCTCAGGCTGTCGCCCTGCTGCCACCTGGACTTGTC | 541<br>542 |
| anti-hHER2-HC-G420-GDSLSWLLRLLN-N421 | 241 | CTGAGCTGGCTGCTGAGACTGCTGAACAACGTGTTCAGCTGCAGCGTGAT<br>G<br>TCTCAGCAGCCAGCTCAGGCTGTCGCCGCCCTGCTGCCACCTGGAC | 543<br>544 |
| anti-hHER2-HC-N421-GDSLSWLLRLLN-V422 | 242 | CTGAGCTGGCTGCTGAGACTGCTGAACGTGTTCAGCTGCAGCGTGATGC<br>TCTCAGCAGCCAGCTCAGGCTGTCGCCGTTGCCCTGCTGCCACCTGG | 545<br>546 |
| anti-hHER2-HC-H433-GDSLSWLLRLLN-N434 | 243 | CTGAGCTGGCTGCTGAGACTGCTGAACAACCACTACACCCAGAAGAGCCT<br>G<br>TCTCAGCAGCCAGCTCAGGCTGTCGCCGTGCAGGGCCTCGTGCATCAC | 547<br>548 |
| anti-hHER2-HC-N434-GDSLSWLLRLLN-H435 | 244 | CTGAGCTGGCTGCTGAGACTGCTGAACCACTACACCCAGAAGAGCCTGAG<br>TCTCAGCAGCCAGCTCAGGCTGTCGCCGTTGTGCAGGGCCTCGTGCATC | 549<br>550 |
| anti-hHER2-HC-S442-GDSLSWLLRLLN-L443 | 245 | CTGAGCTGGCTGCTGAGACTGCTGAACCTGTCCCCCGGCAAGTAATCTAG<br>TCTCAGCAGCCAGCTCAGGCTGTCGCCGCTCAGGCTCTTCTGGGTGTAG | 551<br>552 |
| anti-hHER2-HC-L443-GDSLSWLLRLLN-S444 | 246 | CTGAGCTGGCTGCTGAGACTGCTGAACTCCCCCGGCAAGTAATCTAGACA<br>C<br>TCTCAGCAGCCAGCTCAGGCTGTCGCCCAGGCTCAGGCTCTTCTGGGTG | 553<br>554 |
| anti-hHER2-HC-S444-GDSLSWLLRLLN-P445 | 247 | CTGAGCTGGCTGCTGAGACTGCTGAACCCCGGCAAGTAATCTAGACACCT<br>C<br>TCTCAGCAGCCAGCTCAGGCTGTCGCCGGACAGGCTCAGGCTCTTCTG | 555<br>556 |
| anti-hHER2-HC-P445-GDSLSWLLRLLN-G446 | 248 | CTGAGCTGGCTGCTGAGACTGCTGAACGGCAAGTAATCTAGACACCTCAG<br>AC<br>TCTCAGCAGCCAGCTCAGGCTGTCGCCGGGGGACAGGCTCAGGCTC | 557<br>558 |
| anti-hHER2-HC-G446-GDSLSWLLRLLN-K447 | 139 | CTGAGCTGGCTGCTGAGACTGCTGAACAAGTAATCTAGACACCTCAGACA<br>ATCAAC<br>TCTCAGCAGCCAGCTCAGGCTGTCGCCGCCGGGGGACAGGCTCAG | 559<br>560 |
| anti-hHER2-HC-A118-DSLEFIASKLA-S119 | 249 | CTGGAGTTCATCGCCAGCAAGCTGGCCAGCACCAAGGGCCCCAGCG<br>CTTGCTGGCGATGAACTCCAGGCTGTCAGCCGAGGAGACGGTGACCAG | 561<br>562 |
| anti-hHER2-HC-S119-DSLEFIASKLA-T120 | 250 | CTGGAGTTCATCGCCAGCAAGCTGGCCACCAAGGGCCCCAGCGTGTTC<br>CTTGCTGGCGATGAACTCCAGGCTGTCGCTAGCCGAGGAGACGGTGAC | 563<br>564 |
| anti-hHER2-HC-T120-DSLEFIASKLA-K121 | 251 | CTGGAGTTCATCGCCAGCAAGCTGGCCAAGGGCCCCAGCGTGTTCCC<br>CTTGCTGGCGATGAACTCCAGGCTGTCGGTGCTAGCCGAGGAGACGG | 565<br>566 |
| anti-hHER2-HC-S131-DSLEFIASKLA-S132 | 252 | CTGGAGTTCATCGCCAGCAAGCTGGCCAGCAAGAGCACCAGCGGCGG<br>CTTGCTGGCGATGAACTCCAGGCTGTCGCTGGGGGCCAGGGGGAAC | 567<br>568 |
| anti-hHER2-HC-S132-DSLEFIASKLA-K133 | 253 | CTGGAGTTCATCGCCAGCAAGCTGGCCAAGAGCACCAGCGGCGGCAC<br>CTTGCTGGCGATGAACTCCAGGCTGTCGCTGCTGGGGGCCAGGGG | 569<br>570 |
| anti-hHER2-HC-K133-DSLEFIASKLA-S134 | 254 | CTGGAGTTCATCGCCAGCAAGCTGGCCAGCACCAGCGGCGGCACAG<br>CTTGCTGGCGATGAACTCCAGGCTGTCCTTGCTGCTGGGGGCCAGG | 571<br>572 |
| anti-hHER2-HC-S134-DSLEFIASKLA-T135 | 255 | CTGGAGTTCATCGCCAGCAAGCTGGCCACCAGCGGCGGCACAGCC<br>CTTGCTGGCGATGAACTCCAGGCTGTCGCTCTTGCTGCTGGGGGCC | 573<br>574 |
| anti-hHER2-HC-T135-DSLEFIASKLA-S136 | 256 | CTGGAGTTCATCGCCAGCAAGCTGGCCAGCGGCGGCACAGCCGCC<br>CTTGCTGGCGATGAACTCCAGGCTGTCGGTGCTCTTGCTGCTGGGGG | 575<br>576 |
| anti-hHER2-HC-S136-DSLEFIASKLA-137 | 257 | CTGGAGTTCATCGCCAGCAAGCTGGCCGGCGGCACAGCCGCCCTG<br>CTTGCTGGCGATGAACTCCAGGCTGTCGCTGGTGCTCTTGCTGCTGGG | 577<br>578 |
| anti-hHER2-HC-G137-DSLEFIASKLA-G138 | 258 | CTGGAGTTCATCGCCAGCAAGCTGGCCGGCACAGCCGCCCTGGGC<br>CTTGCTGGCGATGAACTCCAGGCTGTCGCCGCTGGTGCTCTTGCTGC | 579<br>580 |
| anti-hHER2-HC-G138-DSLEFIASKLA-T139 | 259 | CTGGAGTTCATCGCCAGCAAGCTGGCCACAGCCGCCCTGGGCTGC<br>CTTGCTGGCGATGAACTCCAGGCTGTCGCCGCCGCTGGTGCTCTTG | 581<br>582 |
| anti-hHER2-HC-E152-DSLEFIASKLA-P153 | 260 | CTGGAGTTCATCGCCAGCAAGCTGGCCCCCGTGACCGTGTCCTGGAAC<br>CTTGCTGGCGATGAACTCCAGGCTGTCCTCGGGGAAGTAGTCCTTCACC | 583<br>584 |

TABLE 8-continued

DNA sequences of primers used for constructing recombinant PPTase enzymes and
mutants thereof as well as Trastuzumab IgGs with inserted/grafted peptide-tags (HC, heavy
chain; LC, light chain)

| Sequence name | SEQ ID NO | Sequence | SEQ ID NO |
|---|---|---|---|
| anti-hHER2-HC-P153-DSLEFIASKLA-V154 | 261 | CTGGAGTTCATCGCCAGCAAGCTGGCCGTGACCGTGTCCTGGAACAGCG<br>CTTGCTGGCGATGAACTCCAGGCTGTCGGGCTCGGGGAAGTAGTCCTTC | 585<br>586 |
| anti-hHER2-HC-N159-DSLEFIASKLA-S160 | 262 | CTGGAGTTCATCGCCAGCAAGCTGGCCAGCGGAGCCCTGACCTCCG<br>CTTGCTGGCGATGAACTCCAGGCTGTCGTTCCAGGACACGGTCACGGG | 587<br>588 |
| anti-hHER2-HC-S160-DSLEFIASKLA-G161 | 263 | CTGGAGTTCATCGCCAGCAAGCTGGCCGGAGCCCTGACCTCCGGCGTGCA<br>C<br>CTTGCTGGCGATGAACTCCAGGCTGTCGCTGTTCCAGGACACGGTCACG | 589<br>590 |
| anti-hHER2-HC-G161-DSLEFIASKLA-A162 | 264 | CTGGAGTTCATCGCCAGCAAGCTGGCCGCCCTGACCTCCGGCGTG<br>CTTGCTGGCGATGAACTCCAGGCTGTCTCCGCTGTTCCAGGACACGG | 591<br>592 |
| anti-hHER2-HC-A162-DSLEFIASKLA-L163 | 265 | CTGGAGTTCATCGCCAGCAAGCTGGCCCTGACCTCCGGCGTGCACAC<br>CTTGCTGGCGATGAACTCCAGGCTGTCGGCTCCGCTGTTCCAGGACAC | 593<br>594 |
| anti-hHER2-HC-L163-DSLEFIASKLA-T164 | 266 | CTGGAGTTCATCGCCAGCAAGCTGGCCACCTCCGGCGTGCACACCTTC<br>CTTGCTGGCGATGAACTCCAGGCTGTCCAGGGCTCCGCTGTTCCAGG | 595<br>596 |
| anti-hHER2-HC-T164-DSLEFIASKLA-S165 | 267 | CTGGAGTTCATCGCCAGCAAGCTGGCCTCCGGCGTGCACACCTTCCC<br>CTTGCTGGCGATGAACTCCAGGCTGTCGGTCAGGGCTCCGCTGTTCC | 597<br>598 |
| anti-hHER2-HC-S165-DSLEFIASKLA-G166 | 268 | CTGGAGTTCATCGCCAGCAAGCTGGCCGGCGTGCACACCTTCCCCG<br>CTTGCTGGCGATGAACTCCAGGCTGTCGGAGGTCAGGGCTCCGCTG | 599<br>600 |
| anti-hHER2-HC-P171-DSLEFIASKLA-A172 | 269 | CTGGAGTTCATCGCCAGCAAGCTGGCCGCCGTGCTGCAGAGCAGCG<br>CTTGCTGGCGATGAACTCCAGGCTGTCGGGGAAGGTGTGCACGCCG | 601<br>602 |
| anti-hHER2-HC-S176-DSLEFIASKLA-S177 | 270 | CTGGAGTTCATCGCCAGCAAGCTGGCCAGCGGCCTGTACAGCCTGTCC<br>CTTGCTGGCGATGAACTCCAGGCTGTCGCTCTGCAGCACGGCGGG | 603<br>604 |
| anti-hHER2-HC-S177-DSLEFIASKLA-G178 | 271 | CTGGAGTTCATCGCCAGCAAGCTGGCCGGCCTGTACAGCCTGTCCAGC<br>CTTGCTGGCGATGAACTCCAGGCTGTCGCTGCTCTGCAGCACGGCG | 605<br>606 |
| anti-hHER2-HC-P189-DSLEFIASKLA-S190 | 272 | CTGGAGTTCATCGCCAGCAAGCTGGCCAGCAGCAGCCTGGGCACCC<br>CTTGCTGGCGATGAACTCCAGGCTGTCGGGCACTGTCACCACGCTGG | 607<br>608 |
| anti-hHER2-HC-S190-DSLEFIASKLA-S191 | 273 | CTGGAGTTCATCGCCAGCAAGCTGGCCAGCAGCCTGGGCACCCAGAC<br>CTTGCTGGCGATGAACTCCAGGCTGTCGCTGGGCACTGTCACCACGC | 609<br>610 |
| anti-hHER2-HC-S191-DSLEFIASKLA-S192 | 274 | CTGGAGTTCATCGCCAGCAAGCTGGCCAGCCTGGGCACCCAGACCTAC<br>CTTGCTGGCGATGAACTCCAGGCTGTCGCTGCTGGGCACTGTCACCAC | 611<br>612 |
| anti-hHER2-HC-S192-DSLEFIASKLA-L193 | 275 | CTGGAGTTCATCGCCAGCAAGCTGGCCCTGGGCACCCAGACCTACATC<br>CTTGCTGGCGATGAACTCCAGGCTGTCGCTGCTGCTGGGCACTGTCAC | 613<br>614 |
| anti-hHER2-HC-L193-DSLEFIASKLA-G194 | 276 | CTGGAGTTCATCGCCAGCAAGCTGGCCGGCACCCAGACCTACATCTGC<br>CTTGCTGGCGATGAACTCCAGGCTGTCCAGGCTGCTGCTGGGCACTG | 615<br>616 |
| anti-hHER2-HC-G194-DSLEFIASKLA-T195 | 277 | CTGGAGTTCATCGCCAGCAAGCTGGCCACCCAGACCTACATCTGCAACGT<br>G<br>CTTGCTGGCGATGAACTCCAGGCTGTCGCCCAGGCTGCTGCTGGG | 617<br>618 |
| anti-hHER2-HC-T195-DSLEFIASKLA-Q196 | 278 | CTGGAGTTCATCGCCAGCAAGCTGGCCCAGACCTACATCTGCAACGTGAA<br>C<br>CTTGCTGGCGATGAACTCCAGGCTGTCGGTGCCCAGGCTGCTGCTG | 619<br>620 |
| anti-hHER2-HC-Q196-DSLEFIASKLA-T197 | 279 | CTGGAGTTCATCGCCAGCAAGCTGGCCACCTACATCTGCAACGTGAACCA<br>C<br>CTTGCTGGCGATGAACTCCAGGCTGTCCTGGGTGCCCAGGCTGCTG | 621<br>622 |
| anti-hHER2-HC-K205-DSLEFIASKLA-P206 | 280 | CTGGAGTTCATCGCCAGCAAGCTGGCCCCCAGCAACACCAAGGTGGAC<br>CTTGCTGGCGATGAACTCCAGGCTGTCCTTGTGGTTCACGTTGCAGATGTA<br>GG | 623<br>624 |
| anti-hHER2-HC-P206-DSLEFIASKLA-S207 | 281 | CTGGAGTTCATCGCCAGCAAGCTGGCCAGCAACACCAAGGTGGACAAGA<br>AAG<br>CTTGCTGGCGATGAACTCCAGGCTGTCGGGCTTGTGGTTCACGTTGCAG | 625<br>626 |
| anti-hHER2-HC-S207-DSLEFIASKLA-N208 | 282 | CTGGAGTTCATCGCCAGCAAGCTGGCCAACACCAAGGTGGACAAGAAAG<br>TGG<br>CTTGCTGGCGATGAACTCCAGGCTGTCGCTGGGCTTGTGGTTCACGTTG | 627<br>628 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
|---|---|---|---|
| anti-hHER2-HC-P230-DSLEFIASKLA-A231 | 283 | CTGGAGTTCATCGCCAGCAAGCTGGCCGCCCCAGAGCTGCTGGGC<br>CTTGCTGGCGATGAACTCCAGGCTGTCTGGGCAGGGGGGCAGGTG | 629<br>630 |
| anti-hHER2-HC-A231-DSLEFIASKLA-P232 | 284 | CTGGAGTTCATCGCCAGCAAGCTGGCCCCAGAGCTGCTGGGCGGAC<br>CTTGCTGGCGATGAACTCCAGGCTGTCGGCTGGGCAGGGGGGC | 631<br>632 |
| anti-hHER2-HC-P232-DSLEFIASKLA-E233 | 285 | CTGGAGTTCATCGCCAGCAAGCTGGCCGAGCTGCTGGGCGGACCC<br>CTTGCTGGCGATGAACTCCAGGCTGTCTGGGGCTGGGCAGGGGGG | 633<br>634 |
| anti-hHER2-HC-E233-DSLEFIASKLA-L234 | 286 | CTGGAGTTCATCGCCAGCAAGCTGGCCCTGCTGGGCGGACCCTCC<br>CTTGCTGGCGATGAACTCCAGGCTGTCCTCTGGGGCTGGGCAGGG | 635<br>636 |
| anti-hHER2-HC-L234-DSLEFIASKLA-L235 | 287 | CTGGAGTTCATCGCCAGCAAGCTGGCCCTGGGCGGACCCTCCGTG<br>CTTGCTGGCGATGAACTCCAGGCTGTCCAGCTCTGGGGCTGGGCAG | 637<br>638 |
| anti-hHER2-HC-L235-DSLEFIASKLA-G236 | 288 | CTGGAGTTCATCGCCAGCAAGCTGGCCGGCGGACCCTCCGTGTTCC<br>CTTGCTGGCGATGAACTCCAGGCTGTCCAGCAGCTCTGGGGCTGGG | 639<br>640 |
| anti-hHER2-HC-G236-DSLEFIASKLA-G237 | 289 | CTGGAGTTCATCGCCAGCAAGCTGGCCGGACCCTCCGTGTTCCTGTTCC<br>CTTGCTGGCGATGAACTCCAGGCTGTCGCCCAGCAGCTCTGGGGC | 641<br>642 |
| anti-hHER2-HC-P244-DSLEFIASKLA-P245 | 290 | CTGGAGTTCATCGCCAGCAAGCTGGCCCCCAAGCCCAAGGACACCCTG<br>CTTGCTGGCGATGAACTCCAGGCTGTCGGGGAACAGGAACACGGAGGG | 643<br>644 |
| anti-hHER2-HC-P245-DSLEFIASKLA-K246 | 291 | CTGGAGTTCATCGCCAGCAAGCTGGCCAAGCCCAAGGACACCCTGATGATC<br>CTTGCTGGCGATGAACTCCAGGCTGTCGGGGGGGAACAGGAACACGG | 645<br>646 |
| anti-hHER2-HC-I253-DSLEFIASKLA-S254 | 292 | CTGGAGTTCATCGCCAGCAAGCTGGCCAGCAGGACCCCCGAGGTGAC<br>CTTGCTGGCGATGAACTCCAGGCTGTCGATCATCAGGGTGTCCTTGGGC | 647<br>648 |
| anti-hHER2-HC-S254-DSLEFIASKLA-R255 | 293 | CTGGAGTTCATCGCCAGCAAGCTGGCCAGGACCCCCGAGGTGACCTG<br>CTTGCTGGCGATGAACTCCAGGCTGTCGCTGATCATCAGGGTGTCCTTGG | 649<br>650 |
| anti-hHER2-HC-R255-DSLEFIASKLA-T256 | 294 | CTGGAGTTCATCGCCAGCAAGCTGGCCACCCCCGAGGTGACCTGCG<br>CTTGCTGGCGATGAACTCCAGGCTGTCCCTGCTGATCATCAGGGTGTCC | 651<br>652 |
| anti-hHER2-HC-T256-DSLEFIASKLA-P257 | 295 | CTGGAGTTCATCGCCAGCAAGCTGGCCCCCGAGGTGACCTGCGTGG<br>CTTGCTGGCGATGAACTCCAGGCTGTCGGTCCTGCTGATCATCAGGGTG | 653<br>654 |
| anti-hHER2-HC-P257-DSLEFIASKLA-E258 | 296 | CTGGAGTTCATCGCCAGCAAGCTGGCCGAGGTGACCTGCGTGGTGGTG<br>CTTGCTGGCGATGAACTCCAGGCTGTCGGGGGTCCTGCTGATCATCAG | 655<br>656 |
| anti-hHER2-HC-S267-DSLEFIASKLA-H268 | 297 | CTGGAGTTCATCGCCAGCAAGCTGGCCCACGAGGACCCAGAGGTGAAGTTC<br>CTTGCTGGCGATGAACTCCAGGCTGTCGCTCACGTCCACCACCACGC | 657<br>658 |
| anti-hHER2-HC-H268-DSLEFIASKLA-E269 | 298 | CTGGAGTTCATCGCCAGCAAGCTGGCCGAGGACCCAGAGGTGAAGTTCAAC<br>CTTGCTGGCGATGAACTCCAGGCTGTCGTGGCTCACGTCCACCACCAC | 659<br>660 |
| anti-hHER2-HC-E269-DSLEFIASKLA-D270 | 299 | CTGGAGTTCATCGCCAGCAAGCTGGCCGACCCAGAGGTGAAGTTCAACTGG<br>CTTGCTGGCGATGAACTCCAGGCTGTCCTCGTGGCTCACGTCCACCAC | 661<br>662 |
| anti-hHER2-HC-D270-DSLEFIASKLA-P271 | 300 | CTGGAGTTCATCGCCAGCAAGCTGGCCCCAGAGGTGAAGTTCAACTGGTAC<br>CTTGCTGGCGATGAACTCCAGGCTGTCGTCCTCGTGGCTCACGTCCAC | 663<br>664 |
| anti-hHER2-HC-P271-DSLEFIASKLA-E272 | 301 | CTGGAGTTCATCGCCAGCAAGCTGGCCGAGGTGAAGTTCAACTGGTACGTGG<br>CTTGCTGGCGATGAACTCCAGGCTGTCTGGGTCCTCGTGGCTCACGTC | 665<br>666 |
| anti-hHER2-HC-D280-DSLEFIASKLA-G281 | 302 | CTGGAGTTCATCGCCAGCAAGCTGGCCGGCGTGGAGGTGCACAACGC<br>CTTGCTGGCGATGAACTCCAGGCTGTCGTCCACGTACCAGTTGAACTTCAC | 667<br>668 |
| anti-hHER2-HC-H285-DSLEFIASKLA-N286 | 303 | CTGGAGTTCATCGCCAGCAAGCTGGCCAACGCCAAGACCAAGCCCAGAG<br>CTTGCTGGCGATGAACTCCAGGCTGTCGTGCACCTCCACGCCGTCC | 669<br>670 |
| anti-hHER2-HC-N286-DSLEFIASKLA-A287 | 304 | CTGGAGTTCATCGCCAGCAAGCTGGCCGCCAAGACCAAGCCCAGAGAG<br>CTTGCTGGCGATGAACTCCAGGCTGTCGTTGTGCACCTCCACGCCGTC | 671<br>672 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
|---|---|---|---|
| anti-hHER2-HC-P291-DSLEFIASKLA-R292 | 305 | CTGGAGTTCATCGCCAGCAAGCTGGCCAGAGAGGAGCAGTACAACAGCA CC | 673 |
| | | CTTGCTGGCGATGAACTCCAGGCTGTCGGGCTTGGTCTTGGCGTTGTG | 674 |
| anti-hHER2-HC-T307-DSLEFIASKLA-V308 | 306 | CTGGAGTTCATCGCCAGCAAGCTGGCCGTGCTGCACCAGGACTGGCTG | 675 |
| | | CTTGCTGGCGATGAACTCCAGGCTGTCGGTCAGCACGGACACCACCC | 676 |
| anti-hHER2-HC-V308-DSLEFIASKLA-L309 | 307 | CTGGAGTTCATCGCCAGCAAGCTGGCCCTGCACCAGGACTGGCTGAAC | 677 |
| | | CTTGCTGGCGATGAACTCCAGGCTGTCCACGGTCAGCACGGACACCAC | 678 |
| anti-hHER2-HC-L309-DSLEFIASKLA-H310 | 308 | CTGGAGTTCATCGCCAGCAAGCTGGCCCACCAGGACTGGCTGAACGGC | 679 |
| | | CTTGCTGGCGATGAACTCCAGGCTGTCCAGCACGGTCAGCACGGACAC | 680 |
| anti-hHER2-HC-H310-DSLEFIASKLA-Q311 | 309 | CTGGAGTTCATCGCCAGCAAGCTGGCCCAGGACTGGCTGAACGGCAAG | 681 |
| | | CTTGCTGGCGATGAACTCCAGGCTGTCGTGCAGCACGGTCAGCACGG | 682 |
| anti-hHER2-HC-N315-DSLEFIASKLA-G316 | 310 | CTGGAGTTCATCGCCAGCAAGCTGGCCGGCAAGGAATACAAGTGCAAGG TC | 683 |
| | | CTTGCTGGCGATGAACTCCAGGCTGTCGTTCAGCCAGTCCTGGTGCAG | 684 |
| anti-hHER2-HC-G316-DSLEFIASKLA-K317 | 311 | CTGGAGTTCATCGCCAGCAAGCTGGCCAAGGAATACAAGTGCAAGGTCTC CAAC | 685 |
| | | CTTGCTGGCGATGAACTCCAGGCTGTCGCCGTTCAGCCAGTCCTGGTG | 686 |
| anti-hHER2-HC-K317-DSLEFIASKLA-E318 | 312 | CTGGAGTTCATCGCCAGCAAGCTGGCCGAATACAAGTGCAAGGTCTCCAA CAAG | 687 |
| | | CTTGCTGGCGATGAACTCCAGGCTGTCCTTGCCGTTCAGCCAGTCCTG | 688 |
| anti-hHER2-HC-K326-DSLEFIASKLA-A327 | 313 | CTGGAGTTCATCGCCAGCAAGCTGGCCGCCCTGCCAGCCCCCATC | 689 |
| | | CTTGCTGGCGATGAACTCCAGGCTGTCCTTGTTGGAGACCTTGCACTTGTA TTC | 690 |
| anti-hHER2-HC-A327-DSLEFIASKLA-L328 | 314 | CTGGAGTTCATCGCCAGCAAGCTGGCCCTGCCAGCCCCCATCGAAAAG | 691 |
| | | CTTGCTGGCGATGAACTCCAGGCTGTCGGCCTTGTTGGAGACCTTGCAC | 692 |
| anti-hHER2-HC-L328-DSLEFIASKLA-P329 | 315 | CTGGAGTTCATCGCCAGCAAGCTGGCCCCAGCCCCCATCGAAAAGACC | 693 |
| | | CTTGCTGGCGATGAACTCCAGGCTGTCCAGGGCCTTGTTGGAGACCTTG | 694 |
| anti-hHER2-HC-P329-DSLEFIASKLA-A330 | 316 | CTGGAGTTCATCGCCAGCAAGCTGGCCGCCCCCATCGAAAAGACCATCAG | 695 |
| | | CTTGCTGGCGATGAACTCCAGGCTGTCTGGCAGGGCCTTGTTGGAGAC | 696 |
| anti-hHER2-HC-A330-DSLEFIASKLA-P331 | 317 | CTGGAGTTCATCGCCAGCAAGCTGGCCCCCATCGAAAAGACCATCAGCAA G | 697 |
| | | CTTGCTGGCGATGAACTCCAGGCTGTCGGCTGGCAGGGCCTTGTTGG | 698 |
| anti-hHER2-HC-A339-DSLEFIASKLA-K340 | 318 | CTGGAGTTCATCGCCAGCAAGCTGGCCAAGGGCCAGCCACGGGAGC | 699 |
| | | CTTGCTGGCGATGAACTCCAGGCTGTCGGCCTTGCTGATGGTCTTTTCGAT G | 700 |
| anti-hHER2-HC-K340-DSLEFIASKLA-G341 | 319 | CTGGAGTTCATCGCCAGCAAGCTGGCCGGCCAGCCACGGGAGCCC | 701 |
| | | CTTGCTGGCGATGAACTCCAGGCTGTCCTTGGCCTTGCTGATGGTCTTTTC | 702 |
| anti-hHER2-HC-G341-DSLEFIASKLA-Q342 | 320 | CTGGAGTTCATCGCCAGCAAGCTGGCCCAGCCACGGGAGCCCCAG | 703 |
| | | CTTGCTGGCGATGAACTCCAGGCTGTCGCCCTTGGCCTTGCTGATGGTC | 704 |
| anti-hHER2-HC-Q342-DSLEFIASKLA-P343 | 321 | CTGGAGTTCATCGCCAGCAAGCTGGCCCCACGGGAGCCCCAGGTG | 705 |
| | | CTTGCTGGCGATGAACTCCAGGCTGTCCTGGCCCTTGGCCTTGCTGATG | 706 |
| anti-hHER2-HC-P343-DSLEFIASKLA-R344 | 322 | CTGGAGTTCATCGCCAGCAAGCTGGCCCGGGAGCCCCAGGTGTACAC | 707 |
| | | CTTGCTGGCGATGAACTCCAGGCTGTCTGGCTGGCCCTTGGCCTTGC | 708 |
| anti-hHER2-HC-R344-DSLEFIASKLA-E345 | 323 | CTGGAGTTCATCGCCAGCAAGCTGGCCGAGCCCCAGGTGTACACCCTG | 709 |
| | | CTTGCTGGCGATGAACTCCAGGCTGTCCCGTGGCTGGCCCTTGGC | 710 |
| anti-hHER2-HC-R355-DSLEFIASKLA-E356 | 324 | CTGGAGTTCATCGCCAGCAAGCTGGCCGAGGAGATGACCAAGAACCAGG TG | 711 |
| | | CTTGCTGGCGATGAACTCCAGGCTGTCCCGGGAGGGGGCAGGG | 712 |
| anti-hHER2-HC-E356-DSLEFIASKLA-E357 | 325 | CTGGAGTTCATCGCCAGCAAGCTGGCCGAGATGACCAAGAACCAGGTGT CC | 713 |
| | | CTTGCTGGCGATGAACTCCAGGCTGTCCTCCCGGGAGGGGGCAG | 714 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
|---|---|---|---|
| anti-hHER2-HC-E357-DSLEFIASKLA-M358 | 326 | CTGGAGTTCATCGCCAGCAAGCTGGCCATGACCAAGAACCAGGTGTCCCTG | 715 |
| | | CTTGCTGGCGATGAACTCCAGGCTGTCCTCCTCCCGGGAGGGGGG | 716 |
| anti-hHER2-HC-M358-DSLEFIASKLA-T359 | 327 | CTGGAGTTCATCGCCAGCAAGCTGGCCACCAAGAACCAGGTGTCCCTGAC | 717 |
| | | CTTGCTGGCGATGAACTCCAGGCTGTCCATCTCCTCCCGGGAGGGG | 718 |
| anti-hHER2-HC-T359-DSLEFIASKLA-K360 | 122 | CTGGAGTTCATCGCCAGCAAGCTGGCCAAGAACCAGGTGTCCCTGACCTG | 719 |
| | | CTTGCTGGCGATGAACTCCAGGCTGTCGGTCATCTCCTCCCGGGAGG | 720 |
| anti-hHER2-HC-K360-DSLEFIASKLA-N361 | 328 | CTGGAGTTCATCGCCAGCAAGCTGGCCAACCAGGTGTCCCTGACCTGTC | 721 |
| | | CTTGCTGGCGATGAACTCCAGGCTGTCCTTGGTCATCTCCTCCCGGGAG | 722 |
| anti-hHER2-HC-N384-DSLEFIASKLA-G385 | 329 | CTGGAGTTCATCGCCAGCAAGCTGGCCGGCCAGCCCGAGAACAACTAC | 723 |
| | | CTTGCTGGCGATGAACTCCAGGCTGTCGTTGCTCTCCCACTCCACGGC | 724 |
| anti-hHER2-HC-E388-DSLEFIASKLA-N389 | 129 | CTGGAGTTCATCGCCAGCAAGCTGGCCAACAACTACAAGACCACACCTCCAG | 725 |
| | | CTTGCTGGCGATGAACTCCAGGCTGTCCTCGGGCTGGCCGTTGCTC | 726 |
| anti-hHER2-HC-N389-DSLEFIASKLA-N390 | 330 | CTGGAGTTCATCGCCAGCAAGCTGGCCAACTACAAGACCACACCTCCAGTGC | 727 |
| | | CTTGCTGGCGATGAACTCCAGGCTGTCGTTCTCGGGCTGGCCGTTGC | 728 |
| anti-hHER2-HC-T394-DSLEFIASKLA-P395 | 331 | CTGGAGTTCATCGCCAGCAAGCTGGCCCCTCCAGTGCTGGACAGCGAC | 729 |
| | | CTTGCTGGCGATGAACTCCAGGCTGTCTGTGGTCTTGTAGTTGTTCTCGGGC | 730 |
| anti-hHER2-HC-P395-DSLEFIASKLA-P396 | 332 | CTGGAGTTCATCGCCAGCAAGCTGGCCCCAGTGCTGGACAGCGACGG | 731 |
| | | CTTGCTGGCGATGAACTCCAGGCTGTCAGGTGTGGTCTTGTAGTTGTTCTCG | 732 |
| anti-hHER2-HC-D399-DSLEFIASKLA-S400 | 333 | CTGGAGTTCATCGCCAGCAAGCTGGCCAGCGACGGCAGCTTCTTCCTG | 733 |
| | | CTTGCTGGCGATGAACTCCAGGCTGTCGTCCAGCACTGGAGGTGTGGTC | 734 |
| anti-hHER2-HC-S400-DSLEFIASKLA-D401 | 334 | CTGGAGTTCATCGCCAGCAAGCTGGCCGACGGCAGCTTCTTCCTGTACAG | 735 |
| | | CTTGCTGGCGATGAACTCCAGGCTGTCGCTGTCCAGCACTGGAGGTGTG | 736 |
| anti-hHER2-HC-D401-DSLEFIASKLA-G402 | 335 | CTGGAGTTCATCGCCAGCAAGCTGGCCGGCAGCTTCTTCCTGTACAGCAAG | 737 |
| | | CTTGCTGGCGATGAACTCCAGGCTGTCGTCGCTGTCCAGCACTGGAGG | 738 |
| anti-hHER2-HC-S415-DSLEFIASKLA-R416 | 336 | CTGGAGTTCATCGCCAGCAAGCTGGCCAGGTGGCAGCAGGGCAACGTG | 739 |
| | | CTTGCTGGCGATGAACTCCAGGCTGTCGGACTTGTCCACGGTCAGCTTG | 740 |
| anti-hHER2-HC-R416-DSLEFIASKLA-W417 | 337 | CTGGAGTTCATCGCCAGCAAGCTGGCCTGGCAGCAGGGCAACGTGTTC | 741 |
| | | CTTGCTGGCGATGAACTCCAGGCTGTCCCTGGACTTGTCCACGGTCAG | 742 |
| anti-hHER2-HC-W417-DSLEFIASKLA-Q418 | 338 | CTGGAGTTCATCGCCAGCAAGCTGGCCCAGCAGGGCAACGTGTTCAGC | 743 |
| | | CTTGCTGGCGATGAACTCCAGGCTGTCCCACCTGGACTTGTCCACGGTC | 744 |
| anti-hHER2-HC-Q418-DSLEFIASKLA-Q419 | 339 | CTGGAGTTCATCGCCAGCAAGCTGGCCCAGGGCAACGTGTTCAGCTGC | 745 |
| | | CTTGCTGGCGATGAACTCCAGGCTGTCCTGCCACCTGGACTTGTCCAC | 746 |
| anti-hHER2-HC-Q419-DSLEFIASKLA-G420 | 340 | CTGGAGTTCATCGCCAGCAAGCTGGCCGGCAACGTGTTCAGCTGCAGC | 747 |
| | | CTTGCTGGCGATGAACTCCAGGCTGTCCTGCTGCCACCTGGACTTGTC | 748 |
| anti-hHER2-HC-G420-DSLEFIASKLA-N421 | 341 | CTGGAGTTCATCGCCAGCAAGCTGGCCAACGTGTTCAGCTGCAGCGTGATG | 749 |
| | | CTTGCTGGCGATGAACTCCAGGCTGTCGCCCTGCTGCCACCTGGAC | 750 |
| anti-hHER2-HC-N421-DSLEFIASKLA-V422 | 342 | CTGGAGTTCATCGCCAGCAAGCTGGCCGTGTTCAGCTGCAGCGTGATGC | 751 |
| | | CTTGCTGGCGATGAACTCCAGGCTGTCGTTGCCCTGCTGCCACCTGG | 752 |
| anti-hHER2-HC-H433-DSLEFIASKLA-N434 | 343 | CTGGAGTTCATCGCCAGCAAGCTGGCCAACCACTACACCCAGAAGAGCCTG | 753 |
| | | CTTGCTGGCGATGAACTCCAGGCTGTCGTGCAGGGCCTCGTGCATCAC | 754 |
| anti-hHER2-HC-N434-DSLEFIASKLA-H435 | 344 | CTGGAGTTCATCGCCAGCAAGCTGGCCCACTACACCCAGAAGAGCCTGAG | 755 |
| | | CTTGCTGGCGATGAACTCCAGGCTGTCGTTGTGCAGGGCCTCGTGCATC | 756 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
| --- | --- | --- | --- |
| anti-hHER2-HC-S442-DSLEFIASKLA-L443 | 345 | CTGGAGTTCATCGCCAGCAAGCTGGCCCTGTCCCCCGGCAAGTAATCTAG<br>CTTGCTGGCGATGAACTCCAGGCTGTCGCTCAGGCTCTTCTGGGTGTAG | 757<br>758 |
| anti-hHER2-HC-L443-DSLEFIASKLA-S444 | 346 | CTGGAGTTCATCGCCAGCAAGCTGGCCTCCCCCGGCAAGTAATCTAGACA<br>C<br>CTTGCTGGCGATGAACTCCAGGCTGTCCAGGCTCAGGCTCTTCTGGGTG | 759<br>760 |
| anti-hHER2-HC-S444-DSLEFIASKLA-P445 | 347 | CTGGAGTTCATCGCCAGCAAGCTGGCCCCCCGGCAAGTAATCTAGACACCT<br>C<br>CTTGCTGGCGATGAACTCCAGGCTGTCGGACAGGCTCAGGCTCTTCTG | 761<br>762 |
| anti-hHER2-HC-P445-DSLEFIASKLA-G446 | 348 | CTGGAGTTCATCGCCAGCAAGCTGGCCGGCAAGTAATCTAGACACCTCAG<br>AC<br>CTTGCTGGCGATGAACTCCAGGCTGTCGGGGGACAGGCTCAGGCTC | 763<br>764 |
| anti-hHER2-HC-G446-DSLEFIASKLA-K447 | 349 | CTGGAGTTCATCGCCAGCAAGCTGGCCAAGTAATCTAGACACCTCAGACA<br>ATCAAC<br>CTTGCTGGCGATGAACTCCAGGCTGTCGCCGGGGGACAGGCTCAG | 765<br>766 |
| anti-hHER2-LC-T109-GDSLSWLLRLLN-V110 | 31 | CTGAGCTGGCTGCTGAGACTGCTGAACGTGGCCGCTCCCAGCGTG<br>TCTCAGCAGCCAGCTCAGGCTGTCGCCCGTTCGTTTGATCTCCACCTTGGT | 767<br>768 |
| anti-hHER2-LC-V110-GDSLSWLLRLLN-A111 | 32 | CTGAGCTGGCTGCTGAGACTGCTGAACGCCGCTCCCAGCGTGTTCATC<br>TCTCAGCAGCCAGCTCAGGCTGTCGCCCACCGTTCGTTTGATCTCCACCTT<br>G | 769<br>770 |
| anti-hHER2-LC-A111-GDSLSWLLRLLN-A112 | 33 | CTGAGCTGGCTGCTGAGACTGCTGAACGCTCCCAGCGTGTTCATCTTCC<br>TCTCAGCAGCCAGCTCAGGCTGTCGCCGGCCACCGTTCGTTTGATCTCC | 771<br>772 |
| anti-hHER2-LC-P119-GDSLSWLLRLLN-P120 | 34 | CTGAGCTGGCTGCTGAGACTGCTGAACCCCAGCGACGAGCAGCTGAAG<br>TCTCAGCAGCCAGCTCAGGCTGTCGCCGGGGAAGATGAACACGCTGGG | 773<br>774 |
| anti-hHER2-LC-P120-GDSLSWLLRLLN-S121 | 35 | CTGAGCTGGCTGCTGAGACTGCTGAACAGCGACGAGCAGCTGAAGAGC<br>TCTCAGCAGCCAGCTCAGGCTGTCGCCGGGGGGAAGATGAACACGCTG | 775<br>776 |
| anti-hHER2-LC-S121-GDSLSWLLRLLN-D122 | 36 | CTGAGCTGGCTGCTGAGACTGCTGAACGACGAGCAGCTGAAGAGCGGC<br>TCTCAGCAGCCAGCTCAGGCTGTCGCCGCTGGGGGGAAGATGAACAC | 777<br>778 |
| anti-hHER2-LC-D122-GDSLSWLLRLLN-E123 | 37 | CTGAGCTGGCTGCTGAGACTGCTGAACGAGCAGCTGAAGAGCGGCACC<br>TCTCAGCAGCCAGCTCAGGCTGTCGCCGTCGCTGGGGGGAAGATGAAC | 779<br>780 |
| anti-hHER2-LC-Y140-GDSLSWLLRLLN-P141 | 38 | CTGAGCTGGCTGCTGAGACTGCTGAACCCCGGGAGGCCAAGGTG<br>TCTCAGCAGCCAGCTCAGGCTGTCGCCGTAGAAGTTGTTCAGCAGGCACA<br>C | 781<br>782 |
| anti-hHER2-LC-P141-GDSLSWLLRLLN-R142 | 39 | CTGAGCTGGCTGCTGAGACTGCTGAACCGGGAGGCCAAGGTGCAGTG<br>TCTCAGCAGCCAGCTCAGGCTGTCGCCGGGGTAGAAGTTGTTCAGCAGGC | 783<br>784 |
| anti-hHER2-LC-R142-GDSLSWLLRLLN-E143 | 40 | CTGAGCTGGCTGCTGAGACTGCTGAACGAGGCCAAGGTGCAGTGGAAG<br>TCTCAGCAGCCAGCTCAGGCTGTCGCCCCGGGGGTAGAAGTTGTTCAGC | 785<br>786 |
| anti-hHER2-LC-E143-GDSLSWLLRLLN-A144 | 41 | CTGAGCTGGCTGCTGAGACTGCTGAACGCCAAGGTGCAGTGGAAGGTG<br>TCTCAGCAGCCAGCTCAGGCTGTCGCCCTCCCGGGGGTAGAAGTTGTTC | 787<br>788 |
| anti-hHER2-LC-D151-GDSLSWLLRLLN-N152 | 42 | CTGAGCTGGCTGCTGAGACTGCTGAACAACGCCCTGCAGAGCGGCAAC<br>TCTCAGCAGCCAGCTCAGGCTGTCGCCGTCCACCTTCCACTGCACCTTG | 789<br>790 |
| anti-hHER2-LC-N152-GDSLSWLLRLLN-A153 | 43 | CTGAGCTGGCTGCTGAGACTGCTGAACGCCCTGCAGAGCGGCAACAG<br>TCTCAGCAGCCAGCTCAGGCTGTCGCCGTTGTCCACCTTCCACTGCACC | 791<br>792 |
| anti-hHER2-LC-A153-GDSLSWLLRLLN-L154 | 44 | CTGAGCTGGCTGCTGAGACTGCTGAACCTGCAGAGCGGCAACAGCAG<br>TCTCAGCAGCCAGCTCAGGCTGTCGCCGGCGTTGTCCACCTTCCACTG | 793<br>794 |
| anti-hHER2-LC-L154-GDSLSWLLRLLN-Q155 | 45 | CTGAGCTGGCTGCTGAGACTGCTGAACCAGAGCGGCAACAGCCAGGAG<br>TCTCAGCAGCCAGCTCAGGCTGTCGCCCAGGGCGTTGTCCACCTTCCAC | 795<br>796 |
| anti-hHER2-LC-Q155-GDSLSWLLRLLN-S156 | 46 | CTGAGCTGGCTGCTGAGACTGCTGAACAGCGGCAACAGCCAGGAGAGC<br>TCTCAGCAGCCAGCTCAGGCTGTCGCCCTGCAGGGCGTTGTCCACCTTC | 797<br>798 |
| anti-hHER2-LC-E161-GDSLSWLLRLLN-S162 | 47 | CTGAGCTGGCTGCTGAGACTGCTGAACAGCGTCACCGAGCAGGACAGC<br>TCTCAGCAGCCAGCTCAGGCTGTCGCCCTCCTGGCTGTTGCCGCTCTG | 799<br>800 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
|---|---|---|---|
| anti-hHER2-LC-S162-GDSLSWLLRLLN-V163 | 48 | CTGAGCTGGCTGCTGAGACTGCTGAACGTCACCGAGCAGGACAGCAAG<br>TCTCAGCAGCCAGCTCAGGCTGTCGCCGCTCTCCTGGCTGTTGCCGC | 801<br>802 |
| anti-hHER2-LC-V163-GDSLSWLLRLLN-T164 | 49 | CTGAGCTGGCTGCTGAGACTGCTGAACACCGAGCAGGACAGCAAGGAC<br>TCTCAGCAGCCAGCTCAGGCTGTCGCCGACGCTCTCCTGGCTGTTGCC | 803<br>804 |
| anti-hHER2-LC-T164-GDSLSWLLRLLN-E165 | 50 | CTGAGCTGGCTGCTGAGACTGCTGAACGAGCAGGACAGCAAGGACTCC<br>TCTCAGCAGCCAGCTCAGGCTGTCGCCGGTGACGCTCTCCTGGCTGTTG | 805<br>806 |
| anti-hHER2-LC-E165-GDSLSWLLRLLN-Q166 | 51 | CTGAGCTGGCTGCTGAGACTGCTGAACCAGGACAGCAAGGACTCCACC<br>TCTCAGCAGCCAGCTCAGGCTGTCGCCCTCGGTGACGCTCTCCTGGC | 807<br>808 |
| anti-hHER2-LC-Q166-GDSLSWLLRLLN-D167 | 52 | CTGAGCTGGCTGCTGAGACTGCTGAACGACAGCAAGGACTCCACCTACAG<br>TCTCAGCAGCCAGCTCAGGCTGTCGCCCTGCTCGGTGACGCTCTCCTG | 809<br>810 |
| anti-hHER2-LC-D167-GDSLSWLLRLLN-S168 | 53 | CTGAGCTGGCTGCTGAGACTGCTGAACAGCAAGGACTCCACCTACAGCC<br>TCTCAGCAGCCAGCTCAGGCTGTCGCCGTCCTGCTCGGTGACGCTCTC | 811<br>812 |
| anti-hHER2-LC-T197-GDSLSWLLRLLN-H198 | 54 | CTGAGCTGGCTGCTGAGACTGCTGAACCACCAGGGCCTGTCCAGCC<br>TCTCAGCAGCCAGCTCAGGCTGTCGCCGGTCACCTCGCAGGCGTACAC | 813<br>814 |
| anti-hHER2-LC-H198-GDSLSWLLRLLN-Q199 | 55 | CTGAGCTGGCTGCTGAGACTGCTGAACCAGGGCCTGTCCAGCCCC<br>TCTCAGCAGCCAGCTCAGGCTGTCGCCGTGGGTCACCTCGCAGGCG | 815<br>816 |
| anti-hHER2-LC-Q199-GDSLSWLLRLLN-G200 | 56 | CTGAGCTGGCTGCTGAGACTGCTGAACGGCCTGTCCAGCCCCGTG<br>TCTCAGCAGCCAGCTCAGGCTGTCGCCCTGGTGGGTCACCTCGCAGG | 817<br>818 |
| anti-hHER2-LC-G200-GDSLSWLLRLLN-L201 | 57 | CTGAGCTGGCTGCTGAGACTGCTGAACCTGTCCAGCCCCGTGACCAAG<br>TCTCAGCAGCCAGCTCAGGCTGTCGCCGCCCTGGTGGGTCACCTCG | 819<br>820 |
| anti-hHER2-LC-L201-GDSLSWLLRLLN-S202 | 58 | CTGAGCTGGCTGCTGAGACTGCTGAACTCCAGCCCCGTGACCAAGAGC<br>TCTCAGCAGCCAGCTCAGGCTGTCGCCCAGGCCCTGGTGGGTCACC | 821<br>822 |
| anti-hHER2-LC-S202-GDSLSWLLRLLN-S203 | 59 | CTGAGCTGGCTGCTGAGACTGCTGAACAGCCCCGTGACCAAGAGCTTC<br>TCTCAGCAGCCAGCTCAGGCTGTCGCCGGACAGGCCCTGGTGGGTC | 823<br>824 |
| anti-hHER2-LC-S203-GDSLSWLLRLLN-P204 | 60 | CTGAGCTGGCTGCTGAGACTGCTGAACCCCGTGACCAAGAGCTTCAACAG<br>TCTCAGCAGCCAGCTCAGGCTGTCGCCGCTGGACAGGCCCTGGTGG | 825<br>826 |
| anti-hHER2-LC-K207-GDSLSWLLRLLN-S208 | 61 | CTGAGCTGGCTGCTGAGACTGCTGAACAGCTTCAACAGGGGCGAGTGC<br>TCTCAGCAGCCAGCTCAGGCTGTCGCCCTTGGTCACGGGGCTGGACAG | 827<br>828 |
| anti-hHER2-LC-T109-DSLEFIASKLA-V110 | 62 | CTGGAGTTCATCGCCAGCAAGCTGGCCGTGGCCGCTCCCAGCGTG<br>CTTGCTGGCGATGAACTCCAGGCTGTCCGTTCGTTTGATCTCCACCTTGGT | 829<br>830 |
| anti-hHER2-LC-V110-DSLEFIASKLA-A111 | 63 | CTGGAGTTCATCGCCAGCAAGCTGGCCGCCGCTCCCAGCGTGTTCATC<br>CTTGCTGGCGATGAACTCCAGGCTGTCCACCGTTCGTTTGATCTCCACCTTG | 831<br>832 |
| anti-hHER2-LC-A111-DSLEFIASKLA-A112 | 64 | CTGGAGTTCATCGCCAGCAAGCTGGCCGCTCCCAGCGTGTTCATCTTCC<br>CTTGCTGGCGATGAACTCCAGGCTGTCGGCCACCGTTCGTTTGATCTCC | 833<br>834 |
| anti-hHER2-LC-P119-DSLEFIASKLA-P120 | 65 | CTGGAGTTCATCGCCAGCAAGCTGGCCCCCAGCGACGAGCAGCTGAAG<br>CTTGCTGGCGATGAACTCCAGGCTGTCGGGGAAGATGAACACGCTGGG | 835<br>836 |
| anti-hHER2-LC-P120-DSLEFIASKLA-S121 | 66 | CTGGAGTTCATCGCCAGCAAGCTGGCCAGCGACGAGCAGCTGAAGAGC<br>CTTGCTGGCGATGAACTCCAGGCTGTCGGGGGGGAAGATGAACACGCTG | 837<br>838 |
| anti-hHER2-LC-S121-DSLEFIASKLA-D122 | 67 | CTGGAGTTCATCGCCAGCAAGCTGGCCGACGAGCAGCTGAAGAGCGGC<br>CTTGCTGGCGATGAACTCCAGGCTGTCGCTGGGGGGGAAGATGAACAC | 839<br>840 |
| anti-hHER2-LC-D122-DSLEFIASKLA-E123 | 68 | CTGGAGTTCATCGCCAGCAAGCTGGCCGAGCAGCTGAAGAGCGGCACC<br>CTTGCTGGCGATGAACTCCAGGCTGTCGTCGCTGGGGGGGAAGATGAAC | 841<br>842 |
| anti-hHER2-LC-Y140-DSLEFIASKLA-P141 | 69 | CTGGAGTTCATCGCCAGCAAGCTGGCCCCCGGGAGGCCAAGGTG<br>CTTGCTGGCGATGAACTCCAGGCTGTCGTAGAAGTTGTTCAGCAGGCACAC | 843<br>844 |
| anti-hHER2-LC-P141-DSLEFIASKLA-R142 | 70 | CTGGAGTTCATCGCCAGCAAGCTGGCCCGGGAGGCCAAGGTGCAGTG<br>CTTGCTGGCGATGAACTCCAGGCTGTCGGGGTAGAAGTTGTTCAGCAGGC | 845<br>846 |
| anti-hHER2-LC-R142-DSLEFIASKLA-E143 | 71 | CTGGAGTTCATCGCCAGCAAGCTGGCCGAGGCCAAGGTGCAGTGGAAG<br>CTTGCTGGCGATGAACTCCAGGCTGTCCCGGGGGTAGAAGTTGTTCAGC | 847<br>848 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
|---|---|---|---|
| anti-hHER2-LC-E143-DSLEFIASKLA-A144 | 72 | CTGGAGTTCATCGCCAGCAAGCTGGCCGCCAAGGTGCAGTGGAAGGTG<br>CTTGCTGGCGATGAACTCCAGGCTGTCCTCCCGGGGGTAGAAGTTGTTC | 849<br>850 |
| anti-hHER2-LC-D151-DSLEFIASKLA-N152 | 73 | CTGGAGTTCATCGCCAGCAAGCTGGCCAACGCCCTGCAGAGCGGCAAC<br>CTTGCTGGCGATGAACTCCAGGCTGTCGTCCACCTTCCACTGCACCTTG | 851<br>852 |
| anti-hHER2-LC-N152-DSLEFIASKLA-A153 | 74 | CTGGAGTTCATCGCCAGCAAGCTGGCCGCCCTGCAGAGCGGCAACAG<br>CTTGCTGGCGATGAACTCCAGGCTGTCGTTGTCCACCTTCCACTGCACC | 853<br>854 |
| anti-hHER2-LC-A153-DSLEFIASKLA-L154 | 75 | CTGGAGTTCATCGCCAGCAAGCTGGCCCTGCAGAGCGGCAACAGCCAG<br>CTTGCTGGCGATGAACTCCAGGCTGTCGGCGTTGTCCACCTTCCACTG | 855<br>856 |
| anti-hHER2-LC-L154-DSLEFIASKLA-Q155 | 76 | CTGGAGTTCATCGCCAGCAAGCTGGCCCAGAGCGGCAACAGCCAGGAG<br>CTTGCTGGCGATGAACTCCAGGCTGTCCAGGGCGTTGTCCACCTTCCAC | 857<br>858 |
| anti-hHER2-LC-Q155-DSLEFIASKLA-S156 | 77 | CTGGAGTTCATCGCCAGCAAGCTGGCCAGCGGCAACAGCCAGGAGAGC<br>CTTGCTGGCGATGAACTCCAGGCTGTCCTGCAGGGCGTTGTCCACCTTC | 859<br>860 |
| anti-hHER2-LC-E161-DSLEFIASKLA-S162 | 78 | CTGGAGTTCATCGCCAGCAAGCTGGCCAGCGTCACCGAGCAGGACAGC<br>CTTGCTGGCGATGAACTCCAGGCTGTCCTCCTGGCTGTTGCCGCTCTG | 861<br>862 |
| anti-hHER2-LC-S162-DSLEFIASKLA-V163 | 79 | CTGGAGTTCATCGCCAGCAAGCTGGCCGTCACCGAGCAGGACAGCAAG<br>CTTGCTGGCGATGAACTCCAGGCTGTCGCTCTCCTGGCTGTTGCCGC | 863<br>864 |
| anti-hHER2-LC-V163-DSLEFIASKLA-T164 | 80 | CTGGAGTTCATCGCCAGCAAGCTGGCCACCGAGCAGGACAGCAAGGAC<br>CTTGCTGGCGATGAACTCCAGGCTGTCGACGCTCTCCTGGCTGTTGCC | 865<br>866 |
| anti-hHER2-LC-T164-DSLEFIASKLA-E165 | 81 | CTGGAGTTCATCGCCAGCAAGCTGGCCGAGCAGGACAGCAAGGACTCC<br>CTTGCTGGCGATGAACTCCAGGCTGTCGGTGACGCTCTCCTGGCTGTTG | 867<br>868 |
| anti-hHER2-LC-E165-DSLEFIASKLA-Q166 | 82 | CTGGAGTTCATCGCCAGCAAGCTGGCCCAGGACAGCAAGGACTCCACC<br>CTTGCTGGCGATGAACTCCAGGCTGTCCTCGGTGACGCTCTCCTGGC | 869<br>870 |
| anti-hHER2-LC-Q166-DSLEFIASKLA-D167 | 83 | CTGGAGTTCATCGCCAGCAAGCTGGCCGACAGCAAGGACTCCACCTACAG<br>CTTGCTGGCGATGAACTCCAGGCTGTCCTGCTCGGTGACGCTCTCCTG | 871<br>872 |
| anti-hHER2-LC-D167-DSLEFIASKLA-S168 | 84 | CTGGAGTTCATCGCCAGCAAGCTGGCCAGCAAGGACTCCACCTACAGCC<br>CTTGCTGGCGATGAACTCCAGGCTGTCGTCCTGCTCGGTGACGCTCTC | 873<br>874 |
| anti-hHER2-LC-T197-DSLEFIASKLA-H198 | 85 | CTGGAGTTCATCGCCAGCAAGCTGGCCCACCAGGGCCTGTCCAGCC<br>CTTGCTGGCGATGAACTCCAGGCTGTCGGTCACCTCGCAGGCGTACAC | 875<br>876 |
| anti-hHER2-LC-H198-DSLEFIASKLA-Q199 | 86 | CTGGAGTTCATCGCCAGCAAGCTGGCCCAGGGCCTGTCCAGCCCC<br>CTTGCTGGCGATGAACTCCAGGCTGTCGTGGGTCACCTCGCAGGCG | 877<br>878 |
| anti-hHER2-LC-Q199-DSLEFIASKLA-G200 | 87 | CTGGAGTTCATCGCCAGCAAGCTGGCCGGCCTGTCCAGCCCCGTG<br>CTTGCTGGCGATGAACTCCAGGCTGTCCTGGTGGGTCACCTCGCAGG | 879<br>880 |
| anti-hHER2-LC-G200-DSLEFIASKLA-L201 | 88 | CTGGAGTTCATCGCCAGCAAGCTGGCCCTGTCCAGCCCCGTGACCAAG<br>CTTGCTGGCGATGAACTCCAGGCTGTCGCCCTGGTGGGTCACCTCG | 881<br>882 |
| anti-hHER2-LC-L201-DSLEFIASKLA-S202 | 89 | CTGGAGTTCATCGCCAGCAAGCTGGCCTCCAGCCCCGTGACCAAGAGC<br>CTTGCTGGCGATGAACTCCAGGCTGTCCAGGCCCTGGTGGGTCACC | 883<br>884 |
| anti-hHER2-LC-S202-DSLEFIASKLA-S203 | 90 | CTGGAGTTCATCGCCAGCAAGCTGGCCAGCCCCGTGACCAAGAGCTTC<br>CTTGCTGGCGATGAACTCCAGGCTGTCGGACAGGCCCTGGTGGGTC | 885<br>886 |
| anti-hHER2-LC-S203-DSLEFIASKLA-P204 | 91 | CTGGAGTTCATCGCCAGCAAGCTGGCCCCCGTGACCAAGAGCTTCAACAG<br>CTTGCTGGCGATGAACTCCAGGCTGTCGCTGGACAGGCCCTGGTGG | 887<br>888 |
| anti-hHER2-LC-K207-DSLEFIASKLA-S208 | 92 | CTGGAGTTCATCGCCAGCAAGCTGGCCAGCTTCAACAGGGGCGAGTGC<br>CTTGCTGGCGATGAACTCCAGGCTGTCCTTGGTCACGGGGCTGGACAG | 889<br>890 |
| *B. subtilis* Sfp pET22b | | GAAGGAGATATACATATGAAAATTTATGGGATTTACATGGATCGC<br>GTGGTGGTGGTGGTGGTGCAGCAATTCTTCATAGGAGACCATCG | 891<br>892 |
| pET22b | | CACCACCACCACCACCACTGAG<br>CATATGTATATCTCCTTCTTAAAGTTAAACAAAATTATTTC | 893<br>894 |
| TEV into *B. subtilis* Sfp pET22b | | GAGAACCTGTACTTCCAAGGCCACCACCACCACCACCACTGAG<br>GCCTTGGAAGTACAGGTTCTCCAGCAATTCTTCATAGGAGACCATCG | 895<br>896 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
|---|---|---|---|
| B. subtilis Sfp K28E | | GTCTTTCATTTCACCAGAGGAGCGCGAAAAATGCCGTCGCT | 897 |
| | | AGCGACGGCATTTTTCGCGCTCCTCTGGTGAAATGAAAGAC | 898 |
| B. subtilis Sfp T44E | | AAAGAAGATGCTCACCGCGAGCTGCTGGGAGATGTGCTG | 899 |
| | | CAGCACATCTCCCAGCAGCTCGCGGTGAGCATCTTCTTT | 900 |
| B. subtilis Sfp C77Y | | GCAGGAATATGGCAAACCGTATATTCCAGATCTTCCAGATGC | 901 |
| | | GCATCTGGAAGATCTGGAATATACGGTTTGCCATATTCCTGC | 902 |
| E. coli AcpS pET22b | | AATAATTTTGTTTAACTTTAAGAAGGAGATATACATATGGCAATATTAGGT | 903 |
| | | TTAGGCACG | |
| | | CAGTGGTGGTGGTGGTGGTGACTTTCAATAATTACCGTGGCACAAGC | 904 |
| pET22b | | CACCACCACCACCACCACTG | 905 |
| | | ATGTATATCTCCTTCTTAAAGTTAAACAAAATTATT | 906 |
| anti-hHER2-HC-V64L-EFIASKLA-K65 | 99 | CTGGAGTTCATCGCCAGCAAGCTGGCCAAGGGCCGTTTCACTATAAGCGC | 907 |
| | | CTTGCTGGCGATGAACTCCAGGCTATCGGCATATCTAGTATAACCATTCGT AGG | 908 |
| anti-hHER2-HC-S63-LEFIASK-V64 | 97 | GACAGCCTGGAGTTCATCGCCAGCAAGGTCAAGGGCCGTTTCACTATAAG C | 909 |
| | | CTTGCTGGCGATGAACTCCAGGCTGTCGGCATATCTAGTATAACCATTCGT AGG | 910 |
| anti-hHER2-HC-V64L-EFIAS-K65 | 98 | GACAGCCTGGAGTTCATCGCCAGCAAGGGCCGTTTCACTATAAGCGCAGA C | 911 |
| | | CTTGCTGGCGATGAACTCCAGGCTGTCGGCATATCTAGTATAACCATTCGT AGG | 912 |
| anti-hHER2-LC-S76D-S77-L78-EFIASKLA-Q79 | 30 | CTGGAGTTCATCGCCAGCAAGCTGGCCCAGCCGGAAGACTTCGCAACTTA TTAC | 913 |
| | | CTTGCTGGCGATGAACTCCAGGCTGTCGATGGTCAGAGTGAAATCCGTCC | 914 |
| anti-hHER2-HC-S132G-K133D-S134-T135L-S136-G137W-G138L-T139L-A140R-A141L-L142-G143N | 101 | CTGAGCTGGCTGCTGAGACTGCTGAACTGCCTGGTGAAGGACTACTTCC | 915 |
| | | TCTCAGCAGCCAGCTCAGGCTGTCGCCGCTGGGGGCCAGGGGG | 916 |
| anti-hHER2-HC-K133G-S134D-T135S-S136-G137S-G13SW-LLRLLN-T139 | 103 | CTGAGCTGGCTGCTGAGACTGCTGAACACAGCCGCCCTGGGCTGC | 917 |
| | | TCTCAGCAGCCAGCTCAGGCTGTCGCCGCTGCTGGGGGCCAGGG | 918 |
| anti-hHER2-HC-S134G-T135D-S136-G137L-G138S-T139W-A140L | 105 | GGCGACAGCCTGAGCTGGCTGGCCCTGGGCTGCCTGGTG | 919 |
| | | CAGCCAGCTCAGGCTGTCGCCCTTGCTGCTGGGGGCCAGG | 920 |
| anti-hHER2-HC-S134G-T135D-S136-G137L-G138S-T139W-A140L-LRLLN-A141 | 106 | CTGAGACTGCTGAACGCCCTGGGCTGCCTGGTG | 921 |
| | | GTTCAGCAGTCTCAGCAGCCAGCTCAGGCTGTCGC | 922 |
| anti-hHER2-HC-T135G-S136D-G137S-G138L-T139S-WLLRLLN-A140 | 108 | CTGAGCTGGCTGCTGAGACTGCTGAACGCCGCCCTGGGCTGCCTG | 923 |
| | | TCTCAGCAGCCAGCTCAGGCTGTCGCCGCTCTTGCTGCTGGGGGCC | 924 |
| anti-hHER2-HC-T359G-K360D-N361S-Q362L-V363S-S364W | 123 | GGCGACAGCCTGAGCTGGCTGACCTGTCTGGTGAAGGGCTTC | 925 |
| | | CAGCCAGCTCAGGCTGTCGCCCATCTCCTCCCGGGAGGGG | 926 |
| anti-hHER2-HC-S132G-K133D-S134-T135L-S136-G137W-G138L | 100 | GGCGACAGCCTGAGCTGGCTGACAGCCGCCCTGGGCTGC | 927 |
| | | CAGCCAGCTCAGGCTGTCGCCGCTGGGGGCCAGGGGG | 928 |
| anti-hHER2-HC-S134G-T135D-S136-G137L-G138S-T139W-A140L-A141L-L142R-G143L-C144L-L145N | 107 | CTGAGCTGGCTGCTGAGACTGCTGAACGTGAAGGACTACTTCCCCGAGC | 929 |
| | | TCTCAGCAGCCAGCTCAGGCTGTCGCCCTTGCTGCTGGGGGCCAGG | 930 |
| anti-hHER2-HC-L193G-G194D-T195S-Q196L-T197S-Y198W-I199L | 117 | GGCGACAGCCTGAGCTGGCTGTGCAACGTGAACCACAAGCCCAG | 931 |
| | | CAGCCAGCTCAGGCTGTCGCCGCTGCTGCTGGGCACGTC | 932 |
| anti-hHER2-HC-L193G-G194D-T195S-Q196L-T197S-Y198W-I199L-LRLLN-C200 | 118 | CTGAGACTGCTGAACTGCAACGTGAACCACAAGCCCAG | 933 |
| | | GTTCAGCAGTCTCAGCAGCCAGCTCAGGCTGTCGC | 934 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
|---|---|---|---|
| anti-hHER2-HC-L193G-G194D-T195S-Q196L-T197S-Y198W-I199L-C200L-N201R-V202L-N203L-H204N | 119 | CTGAGCTGGCTGCTGAGACTGCTGAACAAGCCCAGCAACACCAAGGTGG<br>TCTCAGCAGCCAGCTCAGGCTGTCGCCGCTGCTGCTGGGCACTGTC | 935<br>936 |
| anti-hHER2-HC-E357G-M358D-T359S-K360L-N361S-Q362W-V363L | 120 | GGCGACAGCCTGAGCTGGCTGTCCCTGACCTGTCTGGTGAAGG<br>CAGCCAGCTCAGGCTGTCGCCCTCCCGGGAGGGGGGC | 937<br>938 |
| anti-hHER2-HC-E388-GDSLSWL-N389 | 126 | GGCGACAGCCTGAGCTGGCTGAACAACTACAAGACCACACCTCCAG<br>CAGCCAGCTCAGGCTGTCGCCCTCGGGCTGGCCGTTGCTC | 939<br>940 |
| anti-hHER2-HC-P189G-S190D-S191-S192L-L193S-G194W-T195L | 109 | GCGACAGCCTGAGCTGGCTGCAGACCTACATCTGCAACGTGAAC<br>CAGCCAGCTCAGGCTGTCGCCCACTGTCACCACGCTGGACAG | 941<br>942 |
| anti-hHER2-HC-P189G-S190D-S191-S192L-L193S-G194W-T195L-Q196L-T197R-Y198L-I199L-C200N | 111 | CTGAGCTGGCTGCTGAGACTGCTGAACAACGTGAACCACAAGCCCAGCAA<br>C<br>TCTCAGCAGCCAGCTCAGGCTGTCGCCCACTGTCACCACGCTGGACAG | 943<br>944 |
| anti-hHER2-HC-L398G-D399-S400-D401L-G402S-S403W-F404L-LRLLN-F405 | 134 | CTGAGCTGGCTGCTGAGACTGCTGAACTTCCTGTACAGCAAGCTGACCGT<br>G<br>TCTCAGCAGCCAGCTCAGGCTGTCGCCCACTGGAGGTGTGGTCTTGTAG | 945<br>946 |
| anti-hHER2-HC-P189G-S190D-S191-S192L-L193S-G194W-T195L-LRLLN-Q196 | 110 | CTGAGACTGCTGAACCAGACCTACATCTGCAACGTGAAC<br>GTTCAGCAGTCTCAGCAGCCAGCTCAGGCTGTCGC | 947<br>948 |
| anti-hHER2-HC-P189D-S190-S191L-S192E-L193F-G194I-T195A-Q196S-T197K-Y198L-I199A | 112 | CTGGAGTTCATCGCCAGCAAGCTGGCCTGCAACGTGAACCACAAGCCCAG<br>CTTGCTGGCGATGAACTCCAGGCTGTCCACTGTCACCACGCTGGACAG | 949<br>950 |
| anti-hHER2-HC-S190G-S191D-S192-L193-G194S-T195W-Q196L-T197L-RLLN-Y198 | 113 | CTGAGCTGGCTGCTGAGACTGCTGAACTACATCTGCAACGTGAACCACAA<br>GC<br>TCTCAGCAGCCAGCTCAGGCTGTCGCCGGGCACTGTCACCACGCTGG | 951<br>952 |
| anti-hHER2-HC-S190D-S191-S192L-L193E-G194F-T195I-Q196A-T197S-Y198K-I199L-C200A | 115 | CTGGAGTTCATCGCCAGCAAGCTGGCCAACGTGAACCACAAGCCCAGCAA<br>C<br>CTTGCTGGCGATGAACTCCAGGCTGTCGGGCACTGTCACCACGCTGG | 953<br>954 |
| anti-hHER2-HC-D413-K414S-S415L-R416S-W417-Q418L-Q419L-G420R-N421L-V422L | 137 | AGCCTGAGCTGGCTGCTGAGACTGCTGTTCAGCTGCAGCGTGATGCACG<br>CAGCAGTCTCAGCAGCCAGCTCAGGCTGTCCACGGTCAGCTTGCTGTAC | 955<br>956 |
| anti-hHER2-HC-D413-K414S-S415L-R416E-W417F-Q418I-Q419L-G420S-N421K-V422L | 138 | AGCCTGGAGTTCATCGCCAGCAAGCTGTTCAGCTGCAGCGTGATGCACG<br>CAGCTTGCTGGCGATGAACTCCAGGCTGTCCACGGTCAGCTTGCTGTAC | 957<br>958 |
| anti-hHER2-HC-E382-S383-N384L-G385D-Q386F-P387I-E388A | 125 | GACAGCCTGGAGTTCATCGCCAACAACTACAAGACCACACCTCCAG<br>GGCGATGAACTCCAGGCTGTCCCACTCCACGGCGATGTCGC | 959<br>960 |
| anti-hHER2-HC-E382-S383-N384L-G385S-Q386W-P387L-E388L | 124 | GACAGCCTGAGCTGGCTGCTGAACAACTACAAGACCACACCTCCAG<br>CAGCCAGCTCAGGCTGTCCCACTCCACGGCGATGTCGC | 961<br>962 |
| anti-hHER2-HC-V2-GDSLSWLLRLLN-Q3 | 94 | CTGAGCTGGCTGCTGAGACTGCTGAACCAGCTGGTGGAGTCTGGCGG<br>TCTCAGCAGCCAGCTCAGGCTGTCGCCAACCTCAGCAGTGGCACCGGG | 963<br>964 |
| anti-hHER2-LC-I2-GDSLSWLLRLLN-Q3 | 26 | CTGAGCTGGCTGCTGAGACTGCTGAACCAGATGACCCAGTCCCCGAGC<br>TCTCAGCAGCCAGCTCAGGCTGTCGCCGATATCAGCAGTGGCACCGGG | 965<br>1095 |
| anti-hHER2-LC-C214-GDSLSWLLRLLN | 28 | CTGAGCTGGCTGCTGAGACTGCTGAACTAATCTAGACACCTCAGACAATC<br>AACC<br>TCTCAGCAGCCAGCTCAGGCTGTCGCCGCACTCGCCCCTGTTGAAGC | 966<br>967 |
| anti-hHER2-LC-I2-DSLEFIASKLA-Q3 | 27 | CTGGAGTTCATCGCCAGCAAGCTGGCCCAGATGACCCAGTCCCCGAG<br>CTTGCTGGCGATGAACTCCAGGCTGTCGATATCAGCAGTGGCACCGGG | 968<br>969 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
|---|---|---|---|
| anti-hHER2-LC-C214-DSLEFIASKLA | 29 | CTGGAGTTCATCGCCAGCAAGCTGGCCTAATCTAGACACCTCAGACAATCAACC | 970 |
| | | CTTGCTGGCGATGAACTCCAGGCTGTCGCACTCGCCCCTGTTGAAGC | 971 |
| anti-hHER2-HC-V2-DSLEFIASKLA-Q3 | 95 | CTGGAGTTCATCGCCAGCAAGCTGGCCCAGCTGGTGGAGTCTGGCGG | 972 |
| | | CTTGCTGGCGATGAACTCCAGGCTGTCAACCTCAGCAGTGGCACCGG | 973 |
| anti-hHER2-HC-K447-GDSLSWLLRLLN | 140 | CTGAGCTGGCTGCTGAGACTGCTGAACTAATCTAGACACCTCAGACAATCAACC | 974 |
| | | TCTCAGCAGCCAGCTCAGGCTGTCGCCCTTGCCGGGGGACAGGCTC | 975 |
| anti-hHER2-HC-K447-DSLEFIASKLA | 141 | CTGGAGTTCATCGCCAGCAAGCTGGCCTAATCTAGACACCTCAGACAATCAACC | 976 |
| | | CTTGCTGGCGATGAACTCCAGGCTGTCCTTGCCGGGGGACAGGCTC | 977 |
| anti-hHER2-HC-S132D-K133S-S134L-T135E-S136F-G137I-G138A-T139S-A140K-A141L-L142A | 102 | CTGGAGTTCATCGCCAGCAAGCTGGCCGGCTGCCTGGTGAAGGACTAC | 978 |
| | | CTTGCTGGCGATGAACTCCAGGCTGTCGCTGGGGGCCAGGGGG | 979 |
| anti-hHER2-HC-S190D-S191-S192L-L193E-G194F-T195I-Q196A-T197S-Y198K-I199L | 114 | AGCCTGGAGTTCATCGCCAGCAAGCTGTGCAACGTGAACCACAAGCCCAG | 980 |
| | | CTTGCTGGCGATGAACTCCAGGCTGTCGGGCACTGTCACCACGCTGG | 981 |
| anti-hHER2-HC-S191D-S192-L193-G194E-T195F-Q196I-T197A-Y198S-I199K | 116 | GACAGCCTGGAGTTCATCGCCAGCAAGTGCAACGTGAACCACAAGCCCAG | 982 |
| | | CTTGCTGGCGATGAACTCCAGGCTGTCGCTGGGCACTGTCACCACGC | 983 |
| anti-hHER2-HC-L398D-D399S-S400L-D401E-G402F-S4031-F404A-F405S-L406K-Y407L-S408A | 135 | CTGGAGTTCATCGCCAGCAAGCTGGCCAAGCTGACCGTGGACAAGTCCAG | 984 |
| | | CTTGCTGGCGATGAACTCCAGGCTGTCCACTGGAGGTGTGGTCTTGTAG | 985 |
| anti-hHER2-HC-E388-DSLEFIASK-N389 | 131 | GACAGCCTGGAGTTCATCGCCAGCAAGAACAACTACAAGACCACACCTCCAG | 986 |
| | | CTTGCTGGCGATGAACTCCAGGCTGTCCTCGGGCTGGCCGTTGCTC | 987 |
| anti-hHER2-HC-E388-DSLEFIASKL-N389 | 130 | AGCCTGGAGTTCATCGCCAGCAAGCTGAACAACTACAAGACCACACCTCCAG | 988 |
| | | CTTGCTGGCGATGAACTCCAGGCTGTCCTCGGGCTGGCCGTTGCTC | 989 |
| pET22b/TEV | | GAGAACCTGTACTTCCAAGGCCAC | 990 |
| | | ATGTATATCTCCTTCTTAAAGTTAAACAAAATTATTTC | 991 |
| | | CACCACCACCACCACCACTGAG | 992 |
| PPTase_C. thermocellum_pET22b/TEV | | TTGGAAGTACAGGTTCTCACGTTCGCAGAGGAATTTACACACTTC | 993 |
| | | TAAGAAGGAGATATACATATGGGTTTTCTGCCGAAAGAGAAAAAG | 994 |
| ACP_C. thermocellum_pET22b | | GTGGTGGTGGTGGTGGCTATTATTTTTAATATATTCAACGACGTCGC | 995 |
| | | TAAGAAGGAGATATACATATGTTCGAGAAAGTCCGTAAAATCATTGC | 996 |
| ACP_E. coli_pET22b | | GTGGTGGTGGTGGTGGCGCCTGGTGGCCGTTGATGTAATC | 997 |
| | | TAAGAAGGAGATATACATATGAGCACTATCGAAGAACGCGTTAAG | 998 |
| anti-hHER2-HC-E388-GDSLDMLEWSLM-N389 | 132 | CTGGACATGCTGGAGTGGAGCCTGATGAACAACTACAAGACCACACCTCCAG | 999 |
| | | CCACTCCAGCATGTCCAGGCTGTCGCCCTCGGGCTGGCCGTTGCTC | 1000 |
| anti-hHER2-HC-V2-GDSLDMLEWSLM-Q3 | 96 | CTGGACATGCTGGAGTGGAGCCTGATGCAGCTGGTGGAGTCTGGCGG | 1001 |
| | | CCACTCCAGCATGTCCAGGCTGTCGCCAACCTCAGCAGTGGCACCGG | 1002 |
| mAb2-HC-T359-GDSLSWLLRLLN-K360 | 148 | CTGAGCTGGCTGCTGAGACTGCTGAACAAGAACCAGGTCAGCCTGACCTG | 1003 |
| | | TCTCAGCAGCCAGCTCAGGCTGTCGCCGGTCATCTCCTCCCGGGATG | 1004 |
| mAb2-HC-E388-GDSLSWLLRLLN-N389 | 149 | CTGAGCTGGCTGCTGAGACTGCTGAACAACAACTACAAGACCACGCCTCCC | 1005 |
| | | TCTCAGCAGCCAGCTCAGGCTGTCGCCCTCCGGCTGCCCATTGCTCTC | 1006 |
| anti-hHER2-HC-Y296-GDSLSWLLRLLN-N297 | 143 | CTGAGCTGGCTGCTGAGACTGCTGAACAACAGCACCTACAGGGTGGTGTC | 1007 |
| | | TCTCAGCAGCCAGCTCAGGCTGTCGCCGTACTGCTCCTCTCTGGGCTTG | 1096 |

TABLE 8-continued

DNA sequences of primers used for constructing recombinant PPTase enzymes and mutants thereof as well as Trastuzumab IgGs with inserted/grafted peptide-tags (HC, heavy chain; LC, light chain)

| Sequence name | SEQ ID NO | Sequence | SEQ ID NO |
|---|---|---|---|
| anti-hHER2-HC-N297-GDSLSWLLRLLN-S298 | 145 | CTGAGCTGGCTGCTGAGACTGCTGAACAGCACCTACAGGGTGGTGTCC<br>TCTCAGCAGCCAGCTCAGGCTGTCGCCGTTGTACTGCTCCTCTCTGGGC | 1008<br>1097 |
| anti-hHER2-HC-Y296-DSLEFIASKLA-N297 | 144 | CTGGAGTTCATCGCCAGCAAGCTGGCCAACAGCACCTACAGGGTGGTGTC<br>CTTGCTGGCGATGAACTCCAGGCTGTCGTACTGCTCCTCTCTGGGCTTG | 1009<br>1098 |
| anti-hHER2-HC-N297-DSLEFIASKLA-S298 | 146 | CTGGAGTTCATCGCCAGCAAGCTGGCCAGCACCTACAGGGTGGTGTCC<br>CTTGCTGGCGATGAACTCCAGGCTGTCGTTGTACTGCTCCTCTCTGGGC | 1010<br>1099 |
| Tras_HC_S6_i415_S418A | | GCCCGAGGGCGACGCCCTGAGCTGGCTG<br>CAGCCAGCTCAGGGCGTCGCCCTCGGGC | 1011<br>1100 |
| Human PPTase_N-His6 (PIPE cloning) ('His6' disclosed as SEQ ID NO: 1106) | | CATCACCATCACCATCACGTTTTCCCTGCCAAACGGTTCTGC<br>ACGGGCCCTCTAGACTTATGACTTTGTACCATTTCGTATTGGAATTTC | 1012<br>1101 |
| pRS_N-His6 (PIPE cloning) ('His6' disclosed as SEQ ID NO: 1106) | | TAAGTCTAGAGGGCCCGTTTAAACC<br>GTGATGGTGATGGTGATGAGGCTGAGCAGTGGCACCGG | 1013<br>1102 |
| Human PPTase_C-His6 (PIPE cloning) ('His6' disclosed as SEQ ID NO: 1106) | | GGTGCCACTGCTCAGCCTGTTTTCCCTGCCAAACGGTTCTGC<br>GTGATGGTGATGGTGATGTGACTTTGTACCATTTCGTATTGGAATTTC | 1014<br>1103 |
| pRS_C-His6 (PIPE cloning) ('His6' disclosed as SEQ ID NO: 1106) | | CATCACCATCACCATCACTAAGTCTAG<br>AGGCTGAGCAGTGGCACCGG | 1015<br>1104 |
| T. maritima PPTase | | ATGATAGTCGGTGTGGGTATTGATG<br>TTACTCTCCGATGAGGATGTTACC | 1016<br>1105 |

Top = Forward primer
Bottom = Reverse primer

TABLE 9

Expression yields of Trastuzumab IgGs with inserted/grafted peptide-tags (HC, heavy chain; LC, light chain). The values in brackets, ( ) [ ], correspond to antibody yields after scale-up.

| Construct (whole antibody tested, the name represents part of the HC or LC that contains the peptide tag, the paired wildtype chain is not listed) | Yield per liter culture/mg | Expression scale/L | SEQ ID NO |
|---|---|---|---|
| anti-hHER2-HC-S134G-T135D-S136-G137L-G138S-T139W-A140L | 26 | 0.02 | 105 |
| anti-hHER2-HC-L193G-G194D-T195S-Q196L-T197S-Y198W-I199L | 73 | 0.02 | 117 |
| anti-hHER2-HC-P189G-S190D-S191-S192L-L193S-G194W-T195L | 61 (36) | 0.02 (1) | 109 |
| anti-hHER2-HC-T359G-K360D-N361S-Q362L-V363S-S364W | 43 | 0.02 | 123 |
| anti-hHER2-HC-T359-GDSLSWLLRLLN-K360 | 45 (29) | 0.02 (1) | 121 |
| mAb2-HC-T359-GDSLSWLLRLLN-K360 | 78 | 0.05 | 148 |
| mAb2-HC-E388-GDSLSWLLRLLN-N389 | 26 | 0.05 | 149 |
| anti-hHER2-HC-E357G-M358D-T359S-K360L-N361S-Q362W-V363L | 59 | 0.02 | 120 |
| anti-hHER2-HC-E388-GDSLSWLLRLLN-N389 | 39 (13) [16] | 0.02 (1) [0.5] | 127 |
| anti-hHER2-HC-E388-GDSLSWL-N389 | 39 | 0.02 | 126 |
| anti-hHER2-LC-C214-GDSLSWLLRLLN | 42 | 0.02 | 28 |
| anti-hHER2-HC-S134G-T135D-S136-G137L-G138S-T139W-A140L-LRLLN-A141 | 2 | 0.05 | 106 |
| anti-hHER2-HC-K133G-S134D-T135S-S136S-G137S-G138W-LLRLLN-T139 | 19 | 0.05 | 103 |
| anti-hHER2-HC-P189G-S190D-S191-S192L-L193S-G194W-T195L-LRLLN-Q196 | 48 | 0.3 | 110 |
| anti-hHER2-HC-S190G-S191D-S192-L193-G194S-T195W-Q196L-T197L-RLLN-Y198 | 33 | 0.05 | 113 |
| anti-hHER2-HC-V2-GDSLSWLLRLLN-Q3 | 20 (11) | 0.05 (0.5) | 94 |
| anti-hHER2-LC-12-GDSLSWLLRLLN-Q3 | 3 | 0.05 | 26 |
| anti-hHER2-LC-12-DSLEFIASKLA-Q3 | 43 (29) | 0.05 (0.4) | 27 |
| anti-hHER2-LC-C214-DSLEFIASKLA | 55 | 0.05 | 29 |
| anti-hHER2-HC-V2-DSLEFIASKLA-Q3 | 34 (20) | 0.05 (0.4) | 95 |
| anti-hHER2-HC-K447-DSLEFIASKLA | 32 | 0.05 | 141 |
| anti-hHER2-HC-S132D-K133S-S134L-T135E-S136F-G137I-G138A- | 32 | 0.05 | 102 |

TABLE 9-continued

Expression yields of Trastuzumab IgGs with inserted/grafted peptide-tags
(HC, heavy chain; LC, light chain). The values in brackets, ( ) [ ],
correspond to antibody yields after scale-up.

| Construct (whole antibody tested, the name represents part of the HC or LC that contains the peptide tag, the paired wildtype chain is not listed) | Yield per liter culture/ mg | Expression scale/L | SEQ ID NO |
|---|---|---|---|
| T139S-A140K-A141L-L142A | | | |
| anti-hHER2-HC-S190D-S191-S192L-L193E-G194F-T195I-Q196A-T197S-Y198K-I199L | 41 | 0.05 | 114 |
| anti-hHER2-HC-S191D-S192-L193-G194E-T195F-Q196I-T197A-Y198S-I199K | 30 | 0.05 | 116 |
| anti-hHER2-HC-L398D-D399S-S400L-D401E-G402F-S403I-F404A-F405S-L406K-Y407L-S408A | 13 | 0.05 | 135 |
| anti-hHER2-HC-Y296-GDSLSWLLRLLN-N297 | 23 | 0.05 | 143 |
| anti-hHER2-HC-N297-GDSLSWLLRLLN-S298 | 23 | 0.05 | 145 |
| anti-hHER2-HC-Y296-DSLEFIASKLA-N297 | 21 | 0.05 | 144 |
| anti-hHER2-HC-N297-DSLEFIASKLA-S298 | 23 | 0.05 | 146 |
| anti-hHER2-HC-E388-DSLEFIASKLA-N389 | 36 (15) | 0.05 (0.5) | 129 |
| anti-hHER2-HC-E388-DSLEFIASKL-N389 | 35 (20) | 0.05 (0.5) | 130 |
| anti-hHER2-HC-E388-DSLEFIASK-N389 | 56 | 0.05 | 131 |
| anti-hHER2-HC-T359-DSLEFIASKLA-K360 | 43 (18) | 0.05 (0.5) | 122 |
| anti-hHER2-HC-S190D-S191-S192L-L193E-G194F-T195I-Q196A-T197S-Y198K-I199L-C200A | 19 | 0.05 | 115 |
| anti-hHER2-HC-P189D-S190-S191L-S192E-L193F-G194I-T195A-Q196S-T197K-Y198L-I199A | 40 | 0.05 | 112 |
| anti-hHER2-HC-D413-K414S-S415L-R416E-W417F-Q418I-Q419A-G420S-N421K-V422L | 29 | 0.05 | 138 |
| anti-hHER2-HC-E382D-S383-N384L-G385E-Q386F-P387I-E388A | 39 | 0.05 | 125 |
| anti-hHER2-HC-E382D-S383-N384L-G385S-Q386W-P387L-E388L | 33 | 0.05 | 124 |
| anti-hHER2-LC-S76D-S77-L78-EFIASKLA-Q79 | 13 | 0.05 | 30 |
| anti-hHER2-HC-S63-LEFIASK-V64 | 12 | 0.05 | 97 |
| anti-hHER2-HC-V64L-EFIAS-K65 | 23 | 0.05 | 98 |
| anti-hHER2-HC-V64L-EFIASKLA-K65 | 11 | 0.05 | 99 |
| anti-hHER2-HC-V2-GDSLSWLLRLLN-Q3-E388-DSLEFIASKLA-N389 | 8 (19) | 0.05 (0.4) | 142 |
| anti-hHER2-HC-V2-GDSLDMLEWSLM-Q3 | 56 | 0.05 | 96 |
| anti-hHER2-HC-E388-GDSLDMLEWSLM-N389 | 32 | 0.05 | 132 |

Example 3

Production of Sfp 4'-Phosphopantetheinyl Transferase (PPTase)

The *B. subtilis* Sfp PPTase was cloned into the pET22b expression vector by using the PIPE method (see Klock et al., Proteins 71:982-994 (2008)). To allow cleavage of the C-terminal His$_6$ tag (SEQ ID NO: 1106), a TEV (tobacco etch virus) protease recognition site was inserted downstream of the Sfp coding sequence. All primers used for cloning are listed in Table 8.

Protein expression and purification were performed according to Yin et at (see Nat. Protoc. 1:280-285 (2006)) with some minor modifications. First, a 5 mL LB starter culture was inoculated from the glycerol stock of *E. coli* BL21 (DE3) cells harboring the pET22b/sfp expression plasmid. The culture was grown to saturation by overnight incubation at 37° C. at 300 rpm. The next day, the starter culture was used to inoculate 1 L of TB medium (Sigma), which was agitated at 300 rpm and maintained at 37° C. After reaching an optical density of 0.5 at 600 nm, the culture was induced by the addition of IPTG to a final concentration of 1 mM and the temperature was reduced to 30° C. The culture was shaken for another 12-16 hours and the bacterial cells were harvested by centrifugation. Prior to use, the cell pellet was stored at −20° C.

To initiate protein purification, the frozen pellet was thawed for 15 minutes on ice and re-suspended in a buffer containing 20 mM Tris/HCl (pH 7.9), 0.5 M NaCl, 5 mM imidazole, and 2 U/mL DNase I (3 mL of buffer per g wet weight of cells). Cell lysis was induced by sonication for 4 min, with intervals of 0.5 sec on and 0.5 sec off. In order to remove insoluble cell debris, the resulting lysate was centrifuged at 40,000×g for 20 min at 4° C. The His$_6$-tagged Sfp enzyme ('His$_6$' disclosed as SEQ ID NO: 1106) was then captured by the addition of 4 mL of 50% Ni-NTA slurry (Qiagen) to the cleared lysate. After shaking for 1 hour at 4° C., the resin-lysate mixture was poured into a disposable column (Bio-Rad). The settled resin was washed with 25 column volumes of 50 mM NaH$_2$PO$_4$, 300 mM NaCl, 20 mM imidazole (pH 8.0) and eluted with 5 column volumes of 50 mM NaH$_2$PO$_4$, 300 mM NaCl, 250 mM imidazole (pH 8.0). Purified Sfp enzyme was then dialyzed twice against 10 mM Tris/HCl, 1 mM EDTA, 10% glycerol (pH 7.5) using a Slide-A-Lyzer Dialysis Cassette (Pierce) with a 3.5 kDa cut-off, and subsequently concentrated to a final concentration of at least 100 µM using an Amicon Ultra-15 Centrifugal Filter Unit (Millipore) with a 10 kDa cut-off. Finally, the concentrated enzyme was aliquoted, flash-frozen in liquid nitrogen, and stored at −80° C.

In order to improve the purity of Sfp using reverse Ni-NTA chromatography, a TEV cleavage site was introduced before the C-terminal His$_6$ tag (SEQ ID NO: 1106). Ni-NTA purification of this construct was performed as described above. However, after elution, the Sfp enzyme was exchanged into TEV cleavage buffer containing 50 mM Tris/HCl, 50 mM NaCl (pH 8.0). His$_6$ tag (SEQ ID NO: 1106) removal was carried out by digestion with 7% (w/w) TEV protease at 23° C. for 1 hour and then at 4° C. for 16 hours. The TEV-digested Sfp enzyme was then reloaded onto a Ni-NTA column equilibrated with 1×PBS (pH 7.2). The cleaved enzyme was collected from the column flow-through and from a washing step involving 5 column volumes of 50 mM NaH$_2$PO$_4$, 300 mM NaCl, 20 mM imidazole (pH 8.0). Purified Sfp enzyme was then dialyzed twice against 10 mM Tris/HCl, 1 mM EDTA, 10% glycerol (pH 7.5) using a Slide-A-Lyzer Dialysis Cassette (Pierce) with a 3.5 kDa cut-off. Following dialysis, Sfp was concentrated to a final concentration of at least 100 µM using an Amicon Ultra-15 Centrifugal Filter Unit (Millipore) with a 10 kDa cut-off. Finally, the concentrated enzyme was aliquoted, flash-frozen in liquid nitrogen, and stored at −80° C.

The purity of Sfp was assessed by SDS-PAGE. His$_6$ tag (SEQ ID NO: 1106) removal was verified by LC-MS and Sfp yield was quantified by ultraviolet spectroscopy at 280 nm (ND-1000 UV-Vis Spectrophotometer, NanoDrop Technologies, Wilmington, Del.) using a molar extinction coefficient of 28620 M$^{-1}$cm$^{-1}$. 48 mg of TEV-cleaved Sfp enzyme was obtained per liter culture.

Example 4

Identification and Production of PPTase Homologs and Mutants

Sfp Mutant R4-4

Using standard molecular biology methods, we inserted the following mutations into the *B. subtilis* Sfp PPTase: Lys28Glu, Thr44Glu, and Cys77Tyr. The sequences of the oligonucleotides used for the mutagenesis reactions are listed in Table 8.

For protein expression, 0.5 L of TB medium was inoculated with a 5 mL starter culture. The culture was agitated at 300 rpm and maintained at 37° C. After reaching an optical density of 0.5 at 600 nm, the culture was induced by the addition of IPTG to a final concentration of 1 mM and the temperature was reduced to 30° C. The culture was shaken for another 16 hours at 300 rpm and the bacterial cells were harvested by centrifugation (15 min at 3400 rpm). Prior to use, the cell pellet was stored at −20° C.

The frozen pellet was thawed for 10 minutes on ice and re-suspended in a buffer containing 50 mM Tris/HCl (pH 8), 300 mM NaCl, 10 mM imidazole, 1 U/mL DNase I, and Complete™ EDTA-free protease inhibitor cocktail tablets (Roche)(3 mL of buffer per g wet weight of cells). Cell lysis was induced by sonication for 3 min on ice, with intervals of 0.5 sec on and 0.5 sec off. After incubation for another 10 min on ice, the lysate was centrifuged at 40,000×g for 30 min at 4° C. The His$_6$-tagged Sfp mutant R4-4 ('His$_6$' disclosed as SEQ ID NO: 1106) was then captured by the addition of 2 mL of 50% Ni-NTA slurry (Qiagen) to the cleared lysate. After shaking for 1 hour at 4° C., the resin-lysate mixture was poured into a disposable column (Bio-Rad). The flowthrough was collected and the settled resin was washed with 50 column volumes of 50 mM Tris, 300 mM NaCl, 20 mM imidazole (pH 8.0) and eluted with 5 column volumes of 50 mM Tris, 300 mM NaCl, 250 mM imidazole (pH 8.0). After buffer-exchanging the eluate into TEV protease cleavage buffer containing 50 mM Tris/HCl, 50 mM NaCl (pH 8.0) using a PD-10 column, His$_6$ tag (SEQ ID NO: 1106) removal was carried out by digestion with 7% (w/w) TEV protease at 23° C. for 1 hour and then at 4° C. for 16 hours.

The TEV-digested Sfp mutant R4-4 was then reloaded onto a Ni-NTA column (1 mL bed volume), which was equilibrated with 1×PBS (pH 7.2). The cleaved enzyme was collected from the column flow-through and from a washing step involving 5 column volumes of 50 mM Tris, 300 mM NaCl, 20 mM imidazole (pH 8.0). The purified Sfp mutant R4-4 was then buffer-exchanged against 10 mM Tris/HCl, 1 mM EDTA, 10% glycerol (pH 7.5) using PD-10 columns. According to Bradford assay using BSA as standard, the enzyme had a final concentration of 3.1 mg/mL at a final volume of 17 mL, which corresponds to 105 mg of TEV-cleaved R4-4 mutant per liter culture. Finally, the enzyme was aliquoted into 100 to 1000 µL fractions, flash-frozen in liquid nitrogen, and stored at −80° C. The purity of the enzyme was assessed by SDS-PAGE analysis and His$_6$ tag (SEQ ID NO: 1106) removal was verified by ESI-MS.

AcpS

Using standard molecular biology methods, we cloned the acpS gene from *E. coli* K-12 into a pET22b vector that allows expression of the recombinant enzyme with a C-terminal His6 tag (SEQ ID NO: 1106). The sequences of the oligonucleotides used for cloning are listed in Table 8.

Following inoculation from a saturated 5 mL starter culture, the AcpS enzyme was expressed in 1 L of TB medium. After shaking the culture at 37° C. with 300 rpm, protein production was induced by the addition of 1 mM IPTG at an optical density of 0.5 (600 nm). Protein expression was carried out overnight at 30° C. and 300 rpm. The next day, the cells were harvested by centrifugation at 3400 rpm for 15 min. The cell pellet was stored at −20° C. prior to protein purification.

To initiate protein purification, the frozen pellet was thawed for 10 min on ice and resuspended in buffer (3 mL of buffer per g wet weight of cells) containing 50 mM Tris/HCl (pH 8), 300 mM NaCl, 10 mM imidazole, 1 U/mL DNase I, and Complete™ EDTA-free protease inhibitor cocktail tablets (Roche). Cell lysis was achieved by sonicating the cell suspension on ice for 3 min with intervals of 0.5 sec on and 0.5 sec off. After another incubation period of 10 min on ice, the lysate was centrifuged at 40,000 g for 30 min at 4° C. Then 2 mL of 50% Ni-NTA slurry was added to the cleared lysate and the lysate/resin mixture was shaken for 1 hour at 4° C. The lysate/resin mixture was poured into a disposable column. After collecting the flowthrough, the Ni-NTA column was washed with 50 column volumes of buffer containing 50 mM Tris (pH 8), 300 mM NaCl, and 20 mM imidazole. Elution was performed with 5 column volumes of buffer containing 50 mM Tris (pH 8), 300 mM NaCl, and 250 mM imidazole. Using a 3.5 kDa cut-off dialysis cassette (Slide-A-Lyzer, Thermo Scientific), the eluate was dialyzed overnight into buffer containing 50 mM Tris (pH 8), and 300 mM NaCl. Precipitated protein was removed by using a 0.45 µm filter (Millipore). After addition of glycerol to a final concentration of 10% (v/v), the Ni-NTA-purified protein was flash-frozen in liquid nitrogen and stored at −80° C. (100 and 200 µL aliquots). The purity of AcpS was assessed by SDS-PAGE and the yield was quantified by Bradford assay using BSA as standard. About 13 mg of AcpS enzyme was obtained per liter culture.

*T. maritima* PPTase

*T. maritima* PPTase expression was carried out at a 1 L scale in native FM medium by inoculation with a 10 mL saturated starter culture. The 1 L culture was shaken at 300 rpm at a temperature of 37° C. After 2.5 hours, the culture reached an optical density of 0.5 at 600 nm. Protein production was induced by the addition of arabinose to a final concentration of 0.1% (w/v) and the culture was shaken for an additional 4 hours. Cells were harvested by centrifugation at 4000 rpm for 15 minutes and the cell pellets were stored at −20° C. Initial purification of *T. maritima* PPTase was performed by IMAC (immobilized metal affinity chromatography) using Ni-NTA agarose resin (Qiagen). Cell pellets were thawed and resuspended in 60 mL lysis buffer (40 mM Tris buffer (pH 8.0), 300 mM NaCl, 10 mM Imidazole, 1 mM TCEP). The cell suspension was sonicated on ice for 1.5 minutes (using 1 sec pulses) and centrifuged at 15000 rpm for 30 minutes at 5° C. The cleared lysate was loaded onto a 1.5 mL Ni-NTA column. After collecting the flowthrough, the column was washed with 5 column volumes of wash buffer (40 mM Tris buffer (pH 8.0), 300 mM NaCl, 40 mM imidazole, 10% glycerol, 1 mM TCEP). Protein elution was carried out with 2 column volumes of elution buffer (20 mM Tris buffer (pH 8.0), 150 mM NaCl, 300 mM Imidazole, 1 mM TCEP).

The Ni-NTA eluate was further purified using a Superdex 75 column (GE Healthcare) connected to an Äkta FPLC system. Size-exclusion chromatography (SEC) was performed at flow rate of 1 mL/min in 10 mM Tris buffer (pH 7.4) supplemented with 1 mM EDTA and 10% (v/v) glycerol. After analyzing protein-containing fractions by SDS-PAGE, fractions containing the *T. maritima* PPTase were pooled and dialyzed again against the buffer previously used for SEC. The purified enzyme was then concentrated using an Amicon Ultra-15 Centrifugal Filter Unit (Millipore) with a 10 kDa cut-off. Precipitate was removed by centrifugation at 13000 rpm for 2 min using a table top centrifuge. The concentrated protein (1.0 ring/mL, 48 µM) was aliquoted into 100 µL fractions, flash-frozen in liquid nitrogen, and stored at minus 80° C. The purity of *T. maritima* PPTase was assessed by SDS-PAGE and the yield was quantified by Bradford assay using BSA as standard. After all purification steps, 1.4 mg of AcpS enzyme was obtained per liter culture.

Example 5

Synthesis of Coenzyme A (CoA) Analogs

CoA-maleimidoethylamido-tetramethylrhodamine

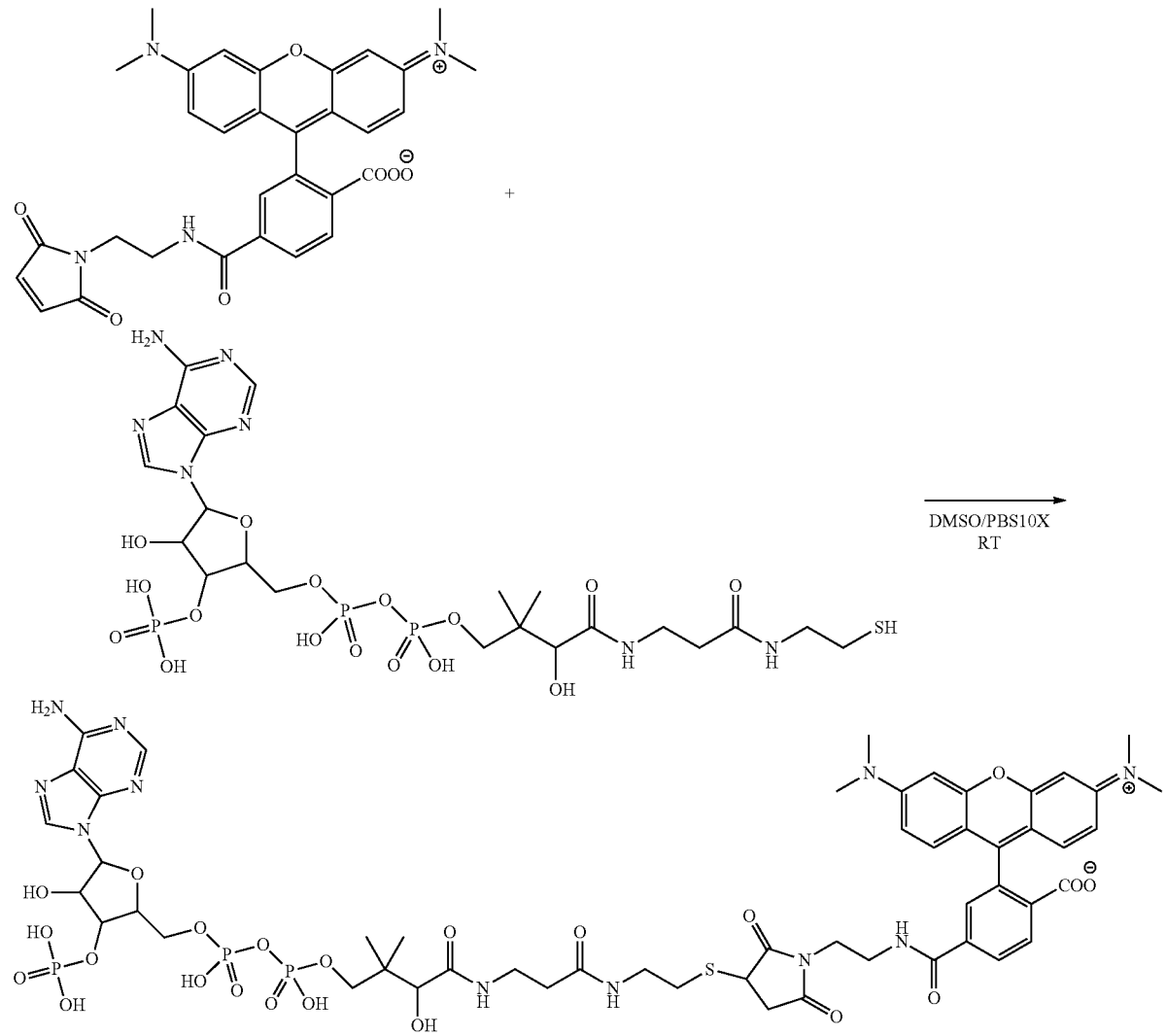

Tetramethylrhodamine-C2-maleimide (5.5 mg, 10.4 µmol) dissolved in 300 µL of DMSO was added to CoA (10.4 µmol in 150 µL water) in 750 µL of 10×PBS buffer and stirred at 23° C. for 1 hour. After the reaction, the reaction mixture was lyophilized to obtain the crude product, which was purified by RP-C18 flash chromatography. Fractions of the desired product were combined and lyophilized to afford CoA-maleimidoethylamido-tetramethylrhodamine (9.8 mg with 94.4% purity) as a dark purple powder. ESI-MS calculated for $C_{52}H_{64}N_{11}O_{22}P_3S$ [MH]$^+$: 1320.3; observed: 1320.3.

CoA-maleimidocaproyl (MC)-MMAF

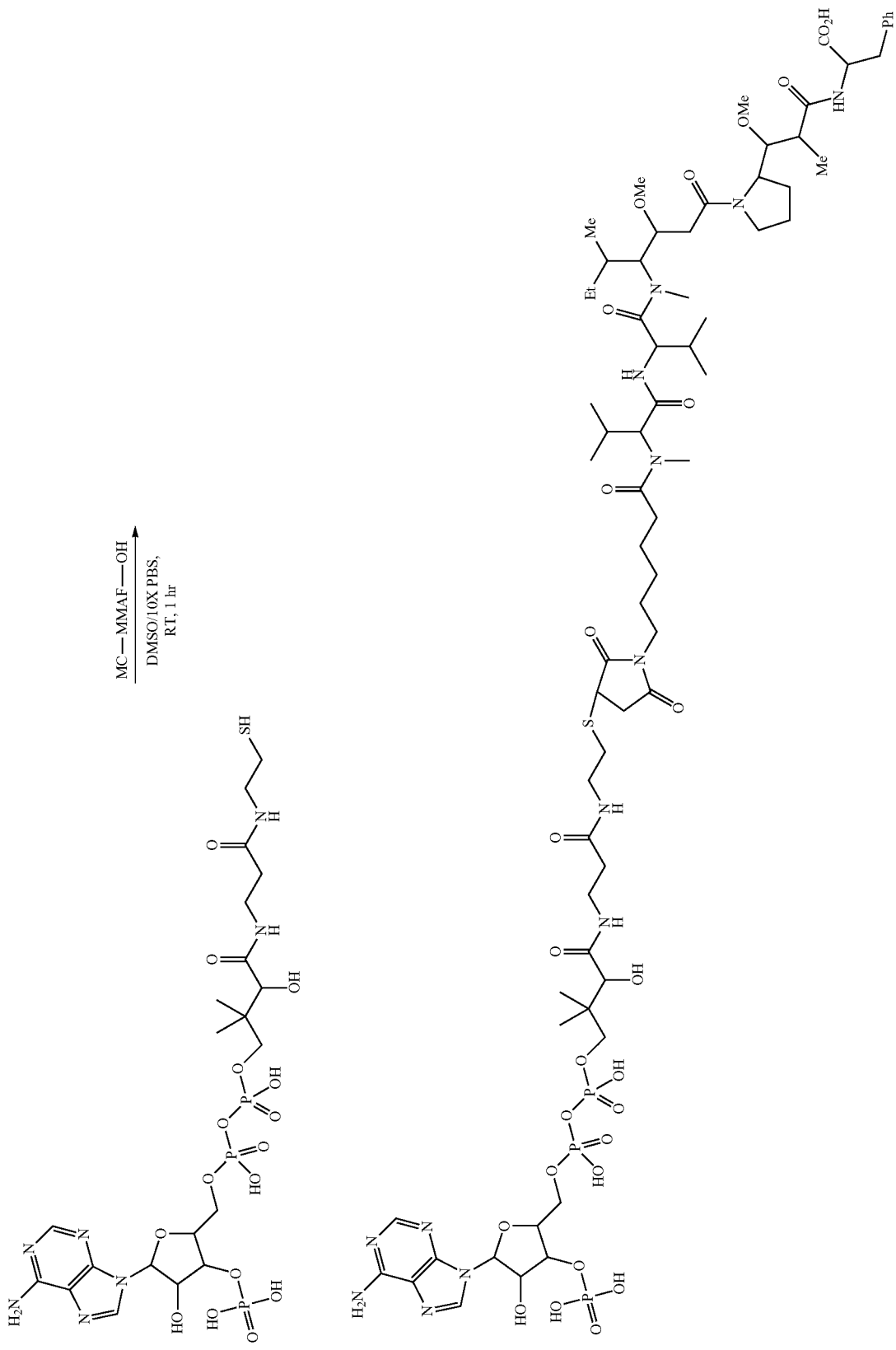

MC-MMAF (see Doronina et al., Bioconj. Chem. 17:114-124 (2006)) (36.0 mg, 38.9 μmol) dissolved in 1.8 mL of DMSO was added to CoA (39.0 μmol in 312 μL water) in 2.9 mL of 10×PBS buffer and stirred at 23° C. for 1 hour. After the reaction, the reaction mixture was lyophilized to obtain the crude material, which was purified by RP-C18 flash chromatography. Fractions of the desired product were combined and lyophilized to afford CoA-MC-MMAF (35.5 mg with 97.5% purity) as a white powder. ESI-MS calculated for $C_{70}H_{112}N_{13}O_{27}P_3S$ [MH]$^+$: 1691.7; observed: 1691.2.

CoA-MC-Val-Cit-PABC-MMAF

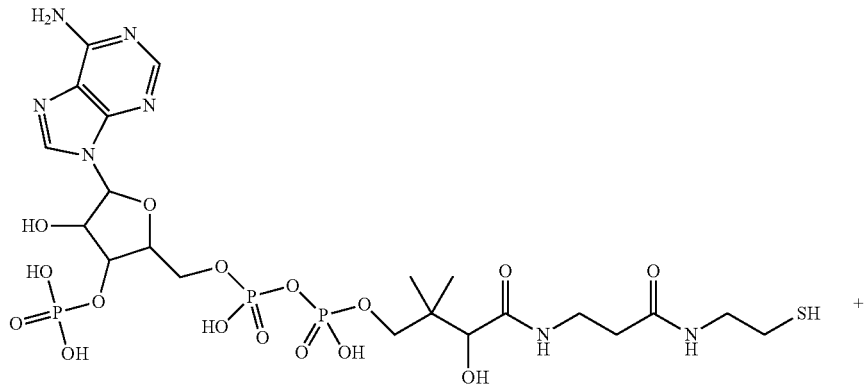

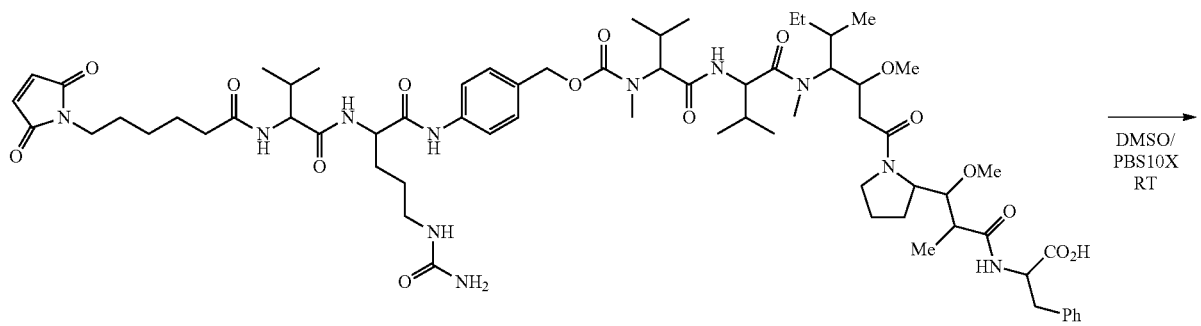

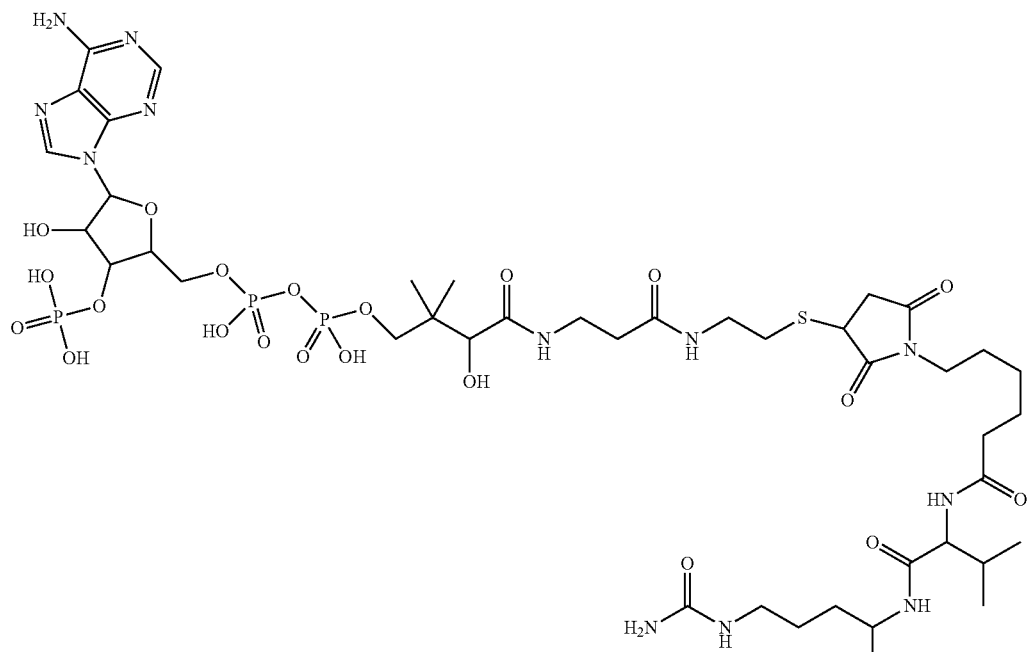

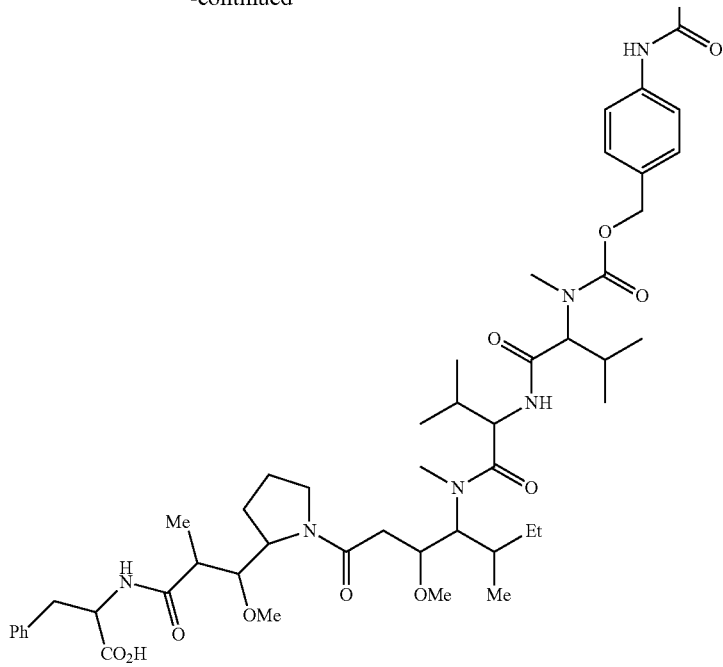

MC-Val-Cit-PABC-MMAF (see Doronina et al., Bioconj. Chem. 17:114-124 (2006))(5.7 mg, 4.3 μmol) dissolved in 300 pt of DMSO was added to CoA (4.3 μmol in 34 μL water) in 2666 μL of 10×PBS buffer and stirred at 23° C. for 1 hour. After the reaction, the reaction mixture was lyophilized to obtain the crude material, which was purified by RP-C18 flash chromatography. Fractions of the desired product were combined and lyophilized to afford CoA-MC-Val-Cit-PABC-MMAF (6.1 mg with 98.0% purity) as a white powder. ESI-MS calculated for $C_{89}H_{139}N_{18}O_{32}P_3S$ $[MH_2]^{2+}/2$: 1049.4; observed: 1049.4.

CoA-Ac-Ahx-MMAF

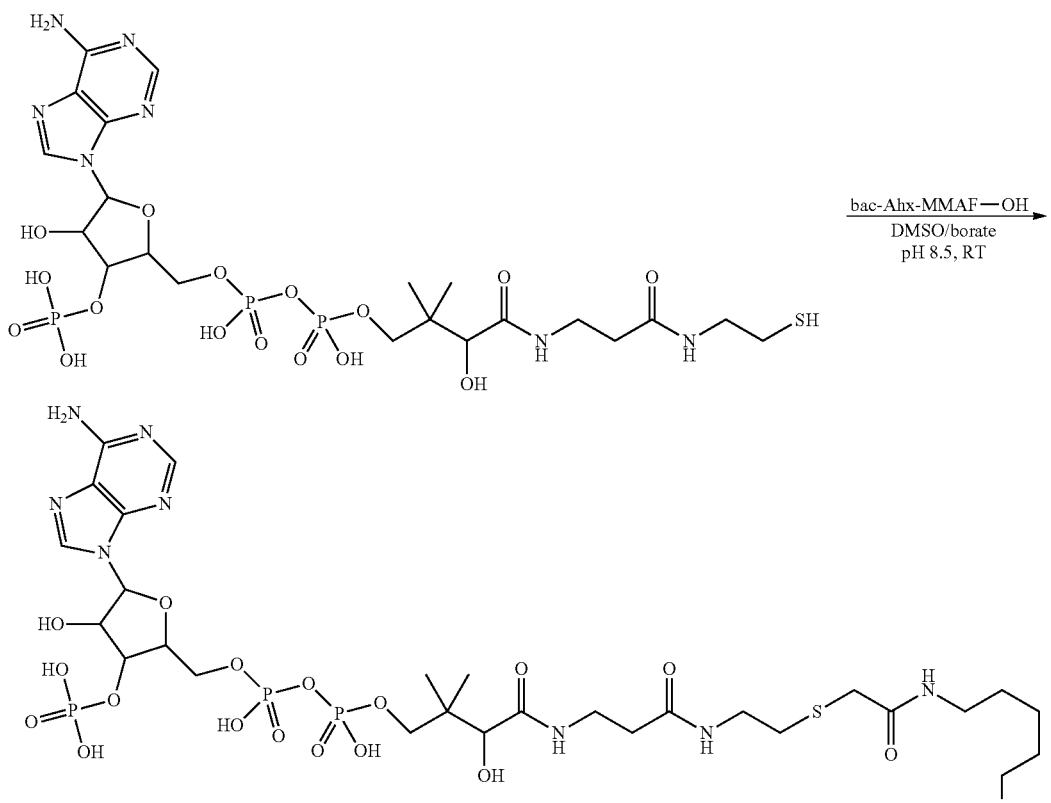

-continued

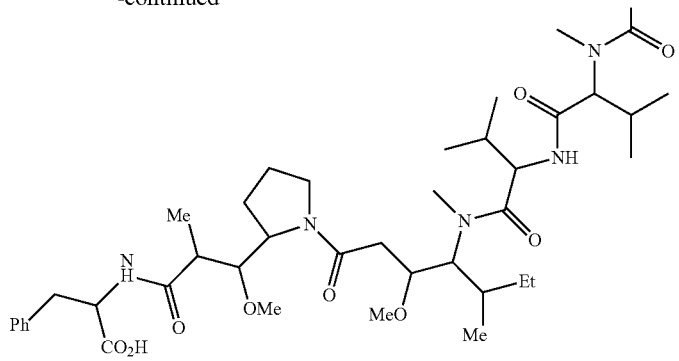

Bromoacetyl-Ahx-MMAF (see, Alley et al., Bioconj. Chem. 19:759-765 (2008)) (1.3 mg, 1.4 μmol) dissolved in 400 μL of DMSO was added to CoA (5.4 μmol in 43 μL water) in 3.6 mL of borate buffer (6.7 mM at pH 8.5) and stirred at 23° C. for 24 hours. After the reaction, the reaction mixture was lyophilized to obtain the crude material, which was purified by RP-C18 flash chromatography. Fractions of the desired product were combined and lyophilized to afford CoA-Ac-Ahx-MMAF (1.1 mg with 96.9% purity) as a white powder. ESI-MS calculated for $C_{68}H_{112}N_{13}O_{26}P_3S$ $[MH]^+$: 1651.7; observed: 1651.3.

CoA-Open-Ring-MC-MMAF

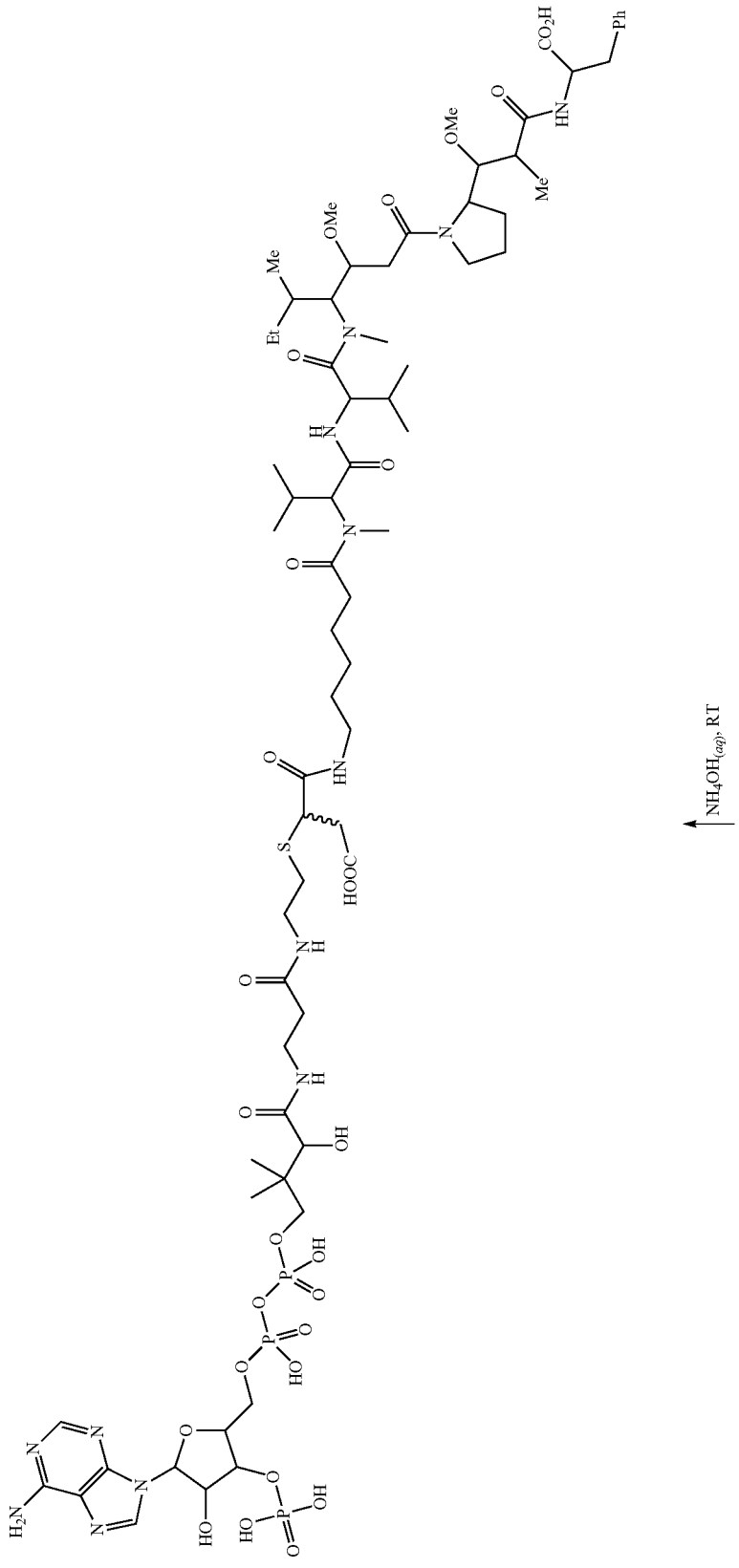

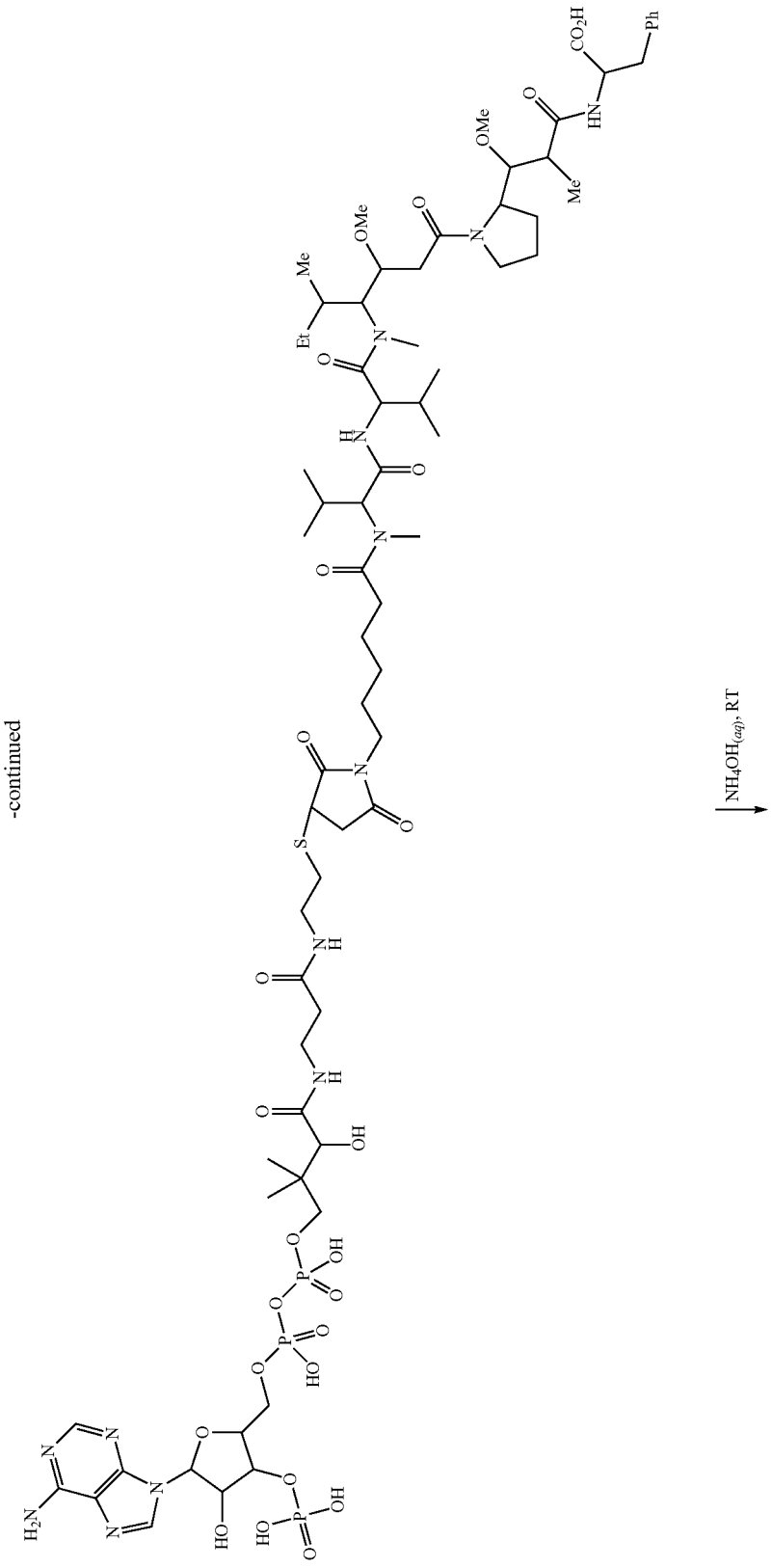

-continued
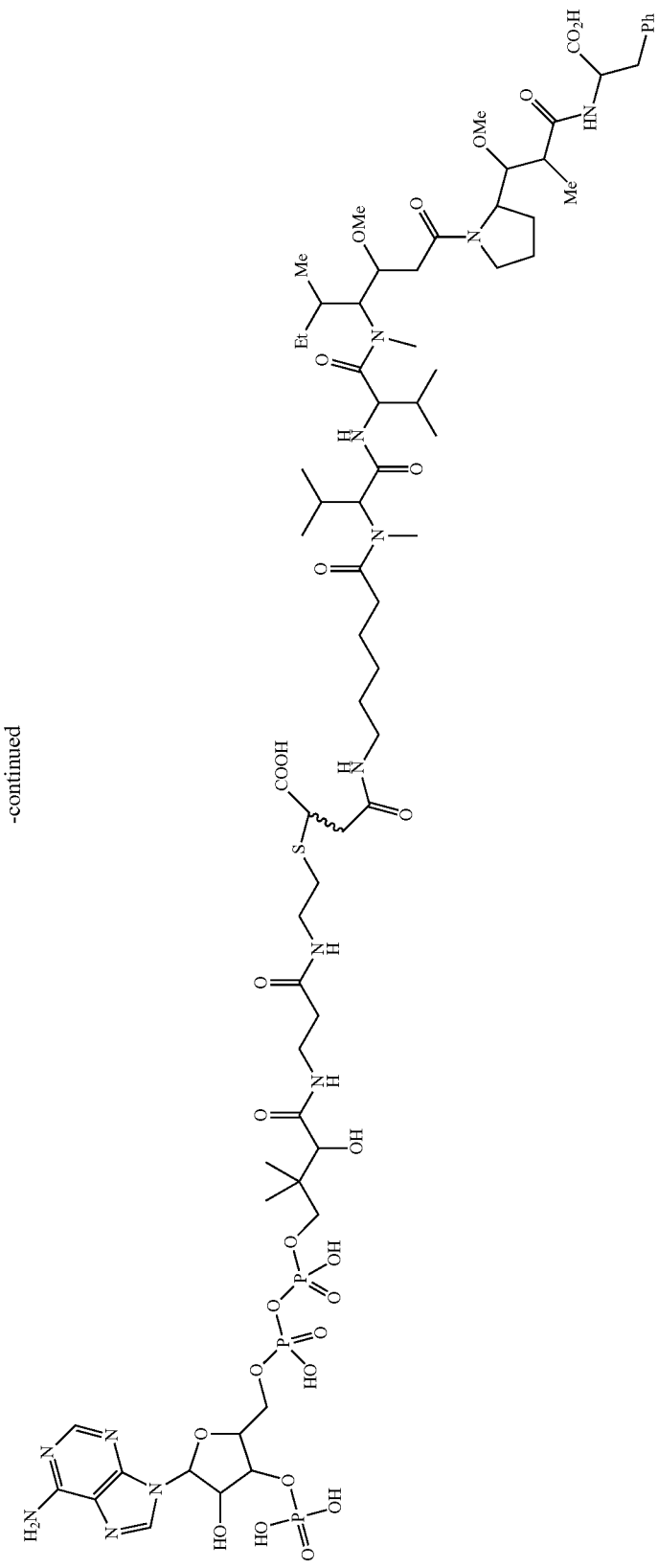

CoA-MC-MMAF (5 µmol in 1 mL of water) was added to 9 mL of 1 M NH$_4$OH$_{(aq)}$ and stirred at 23° C. for 30 minutes. After the reaction, the reaction mixture was lyophilized to obtain the crude material, which was purified by RP-C18 flash chromatography. Fractions of the desired product were combined and lyophilized to afford 3.9 mg of maleimide-ring-opened CoA-MC-MMAF as a mixture of four positional and diastereomeric isomers as shown in the scheme above (white powder, 96.6% purity). ESI-MS calculated for C$_{70}$H$_{114}$N$_{13}$O$_{28}$P$_3$S [MH]$^+$: 1709.7; observed: 1709.2.

Example 6

Labeling of Peptide-Tagged IgGs with CoA Analogs In Vitro

To exemplify the single-step conjugation of CoA analogs to peptide-tagged IgGs in vitro, various peptide-tagged Trastuzumab constructs were reacted with CoA-MC-MMAF in the presence of Sfp enzyme. Generally, conjugation reactions were carried out in 50 or 75 mM HEPES or Tris buffer, pH 7.5 or 8.0 supplemented with 10.0 or 12.5 mM MgCl$_2$. The final concentration of peptide-tagged Trastuzumab was kept constant at 2.5 µM, which corresponds to 5.0 µM per peptide tag, while the final concentration of the CoA substrates was usually varied between 40 µM and 100 µM. To initiate the conjugation reaction, Sfp enzyme was added to give a final concentration of typically 1 µM. The enzymatic reaction was allowed to proceed at either 23° C. or 37° C. for 16 hours. After this time period, the reaction progress was analyzed by ESI-MS and HPLC.

Example 7

Labeling of Insertions

Figure 5:
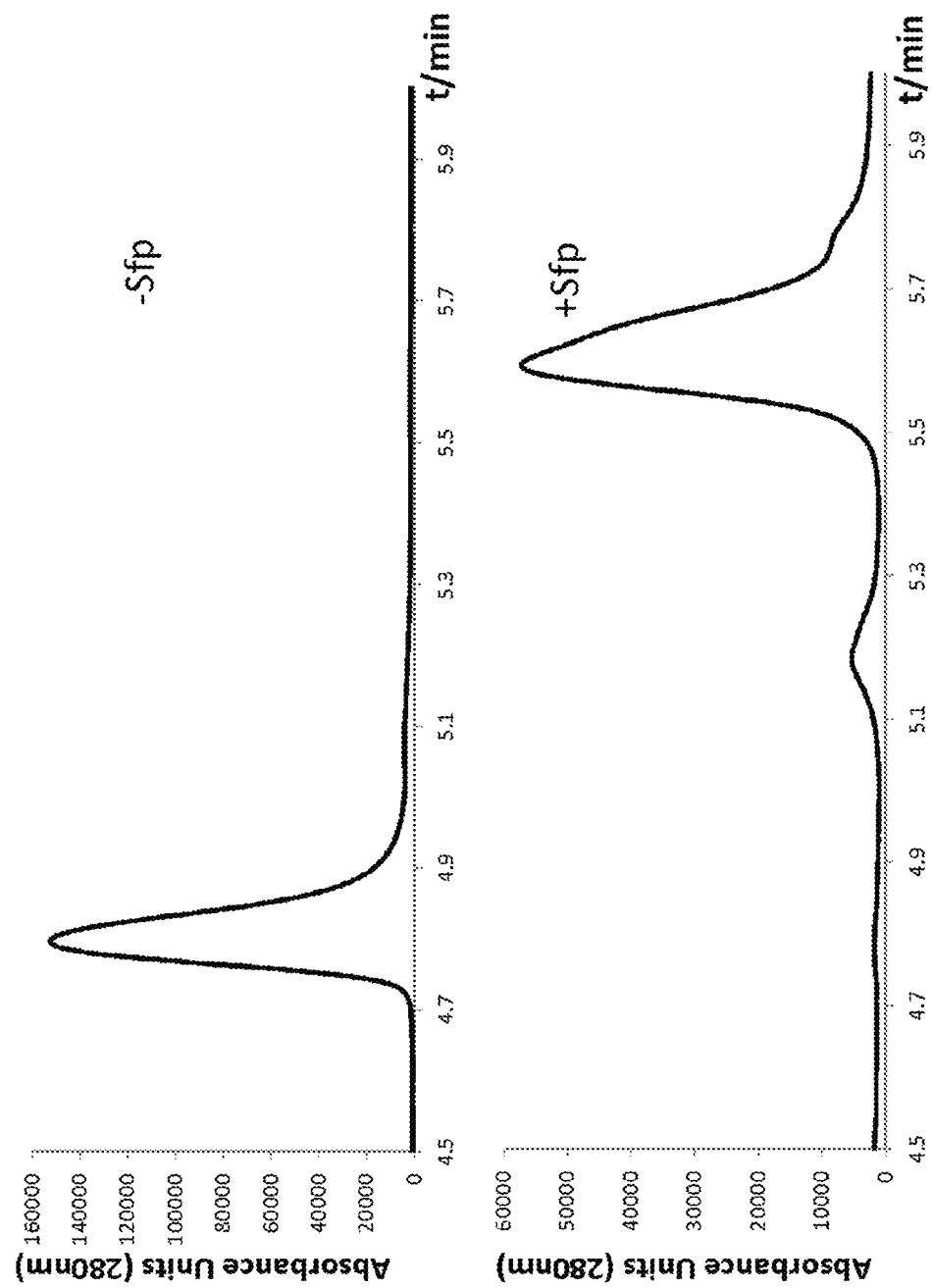
FIG. 5. HPLC characterization of Sfp-catalyzed ADC formation. (A) HPLC trace confirming the near quantitative formation of the immunoconjugate anti-hHER2-HC-T359-GDS-ppan-MC-MMAF-LSWLLRLLN-K360 (SEQ ID NO: 1117). (B) HPLC trace confirming the near quantitative formation of the immunoconjugate anti-hHER2-HC-E388-GDS-ppan-MC-MMAF-LSWLLRLLN-N389 (SEQ ID NO: 1118). (C) HPLC trace confirming the near quantitative formation of the immunoconjugate anti-hHER2-HC-V2-DS-ppan-MC-MMAF-LEFIASKLA-Q3 (SEQ ID NO: 1119). (D) HPLC trace confirming the quantitative formation of the immunoconjugate anti-hHER2-HC-V2-GDSppan-MC-MMAF-LSWLLRLLN-Q3 (SEQ ID NO: 1120). (E) HPLC trace confirming the near quantitative formation of the immunoconjugate anti-hHER2-HC-E388-DS-ppan-MC-MMAF-LEFIASKL-N389 (SEQ ID NO: 1121). (F) HPLC trace confirming the quantitative formation of the immunoconjugate anti-hHER2-HC-E388-DS-ppan-MC-MMAF-LEFIASKLA-N389 (SEQ ID NO: 1122). (G) HPLC trace confirming the near quantitative formation of the immunoconjugate mAb2-HC-T359-GDS-ppan-MC-MMAF-LSWLLRLLN-K360 (SEQ ID NO: 1123). (H) HPLC trace exemplifying partial formation of the immunoconjugate anti-hHER2-LC-I2-DS-ppan-MC-MMAF-LEFIASKLA-Q3 (SEQ ID NO: 1124).
Figure 5:
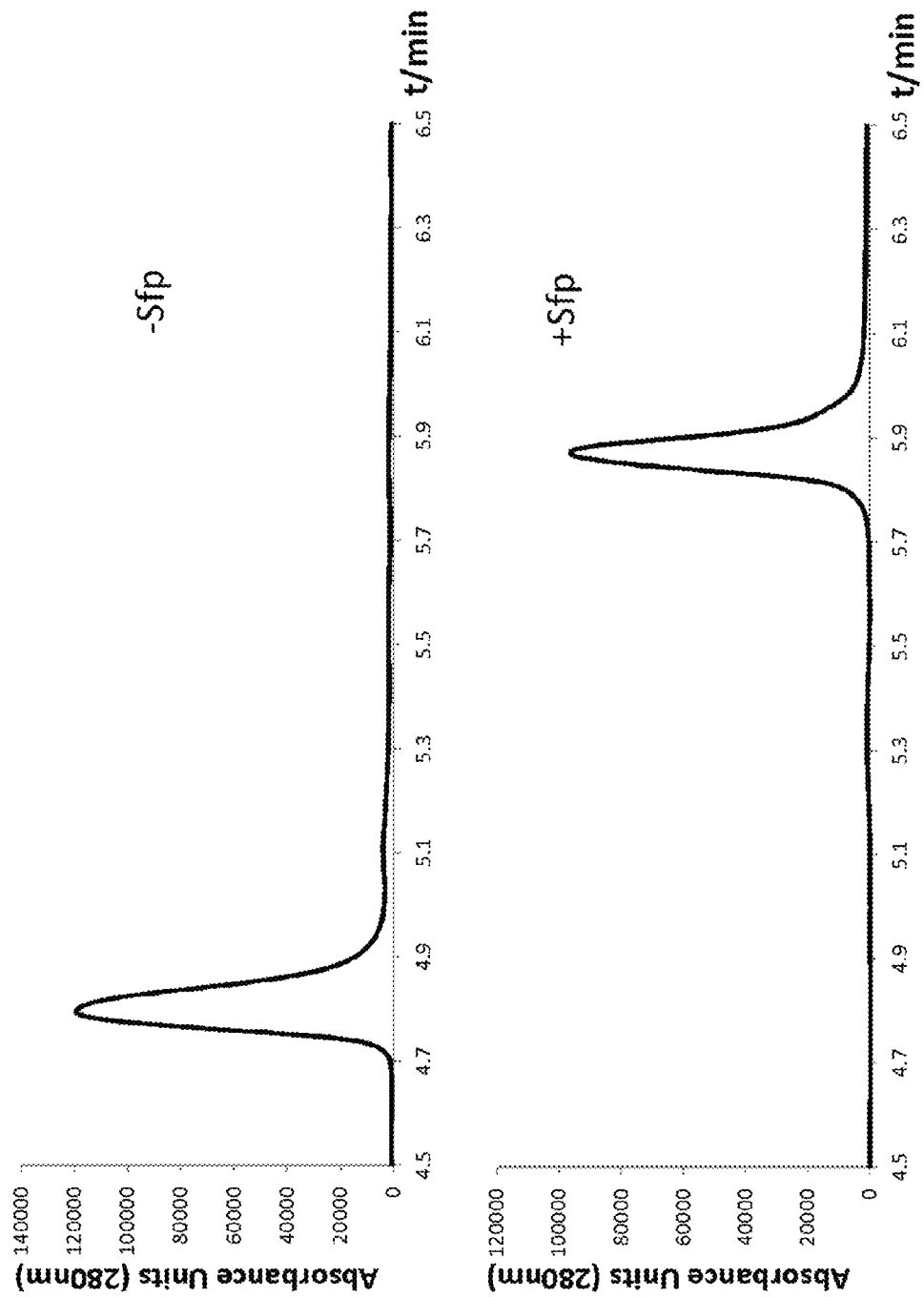
Figure 5:
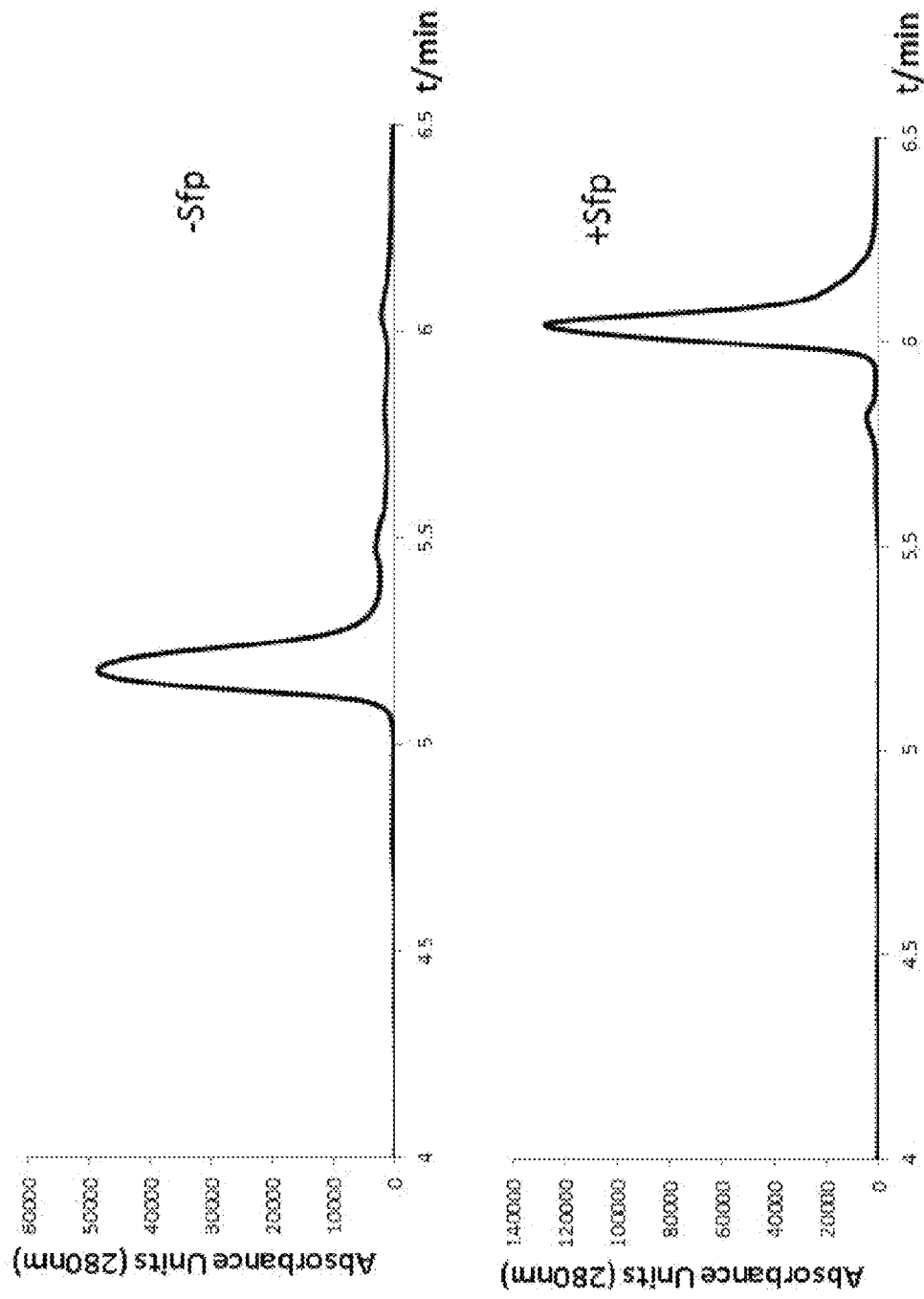
Figure 5:
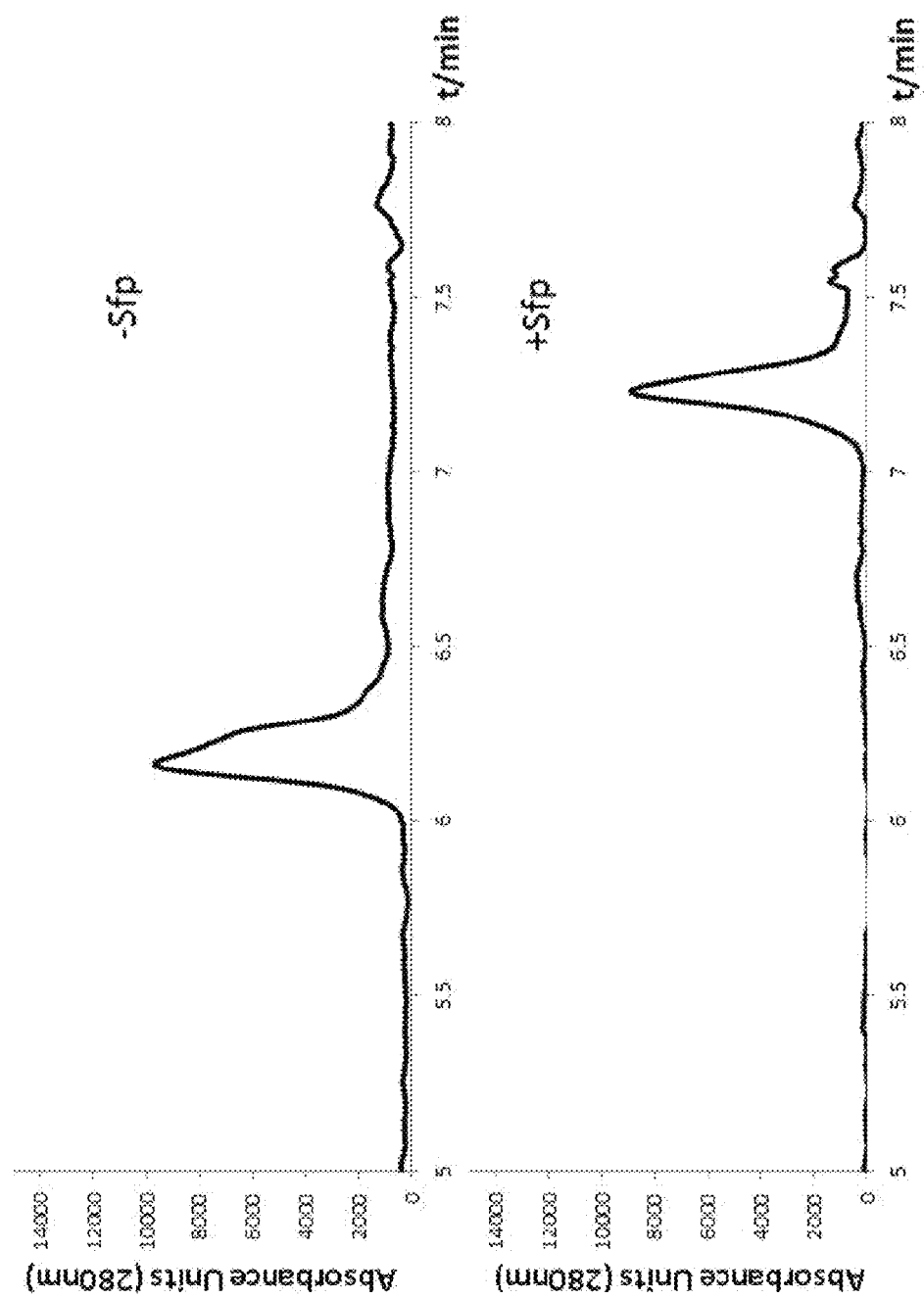
Figure 5:
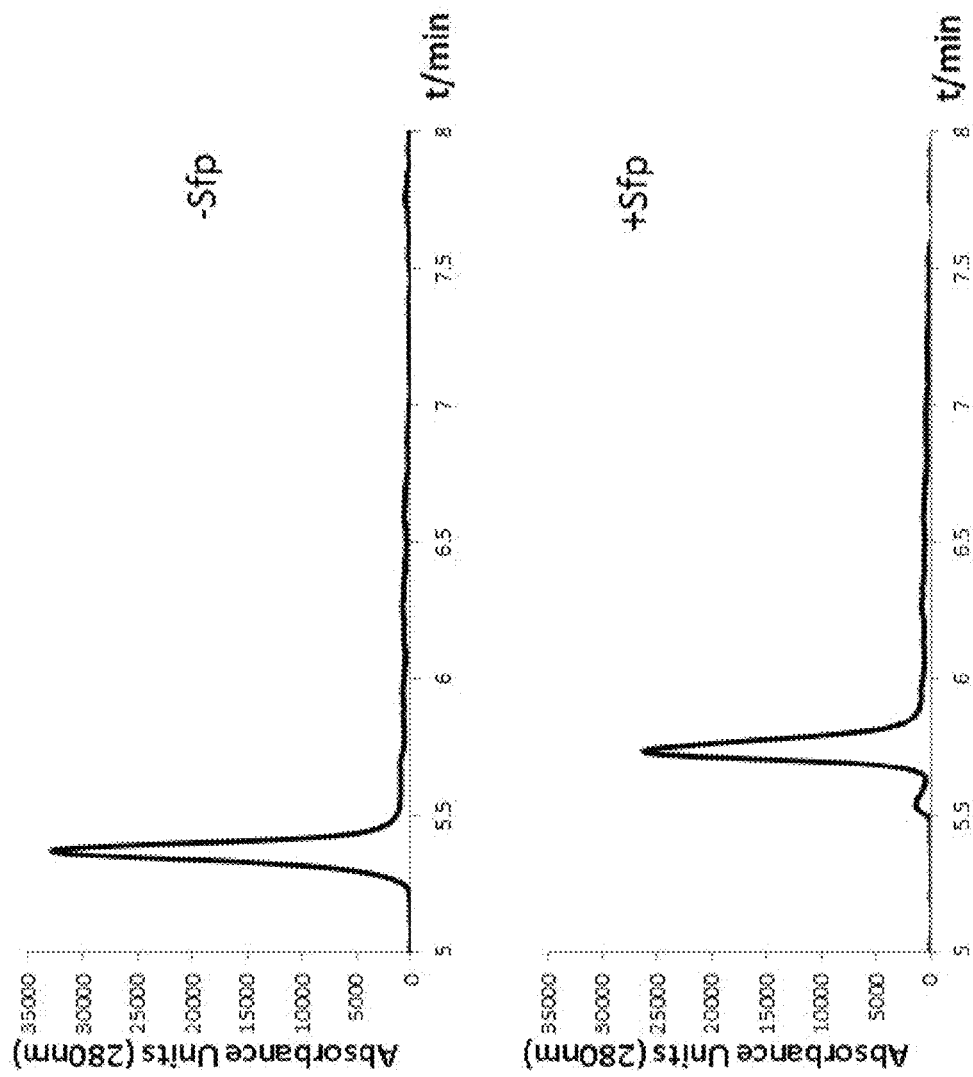
Figure 5:
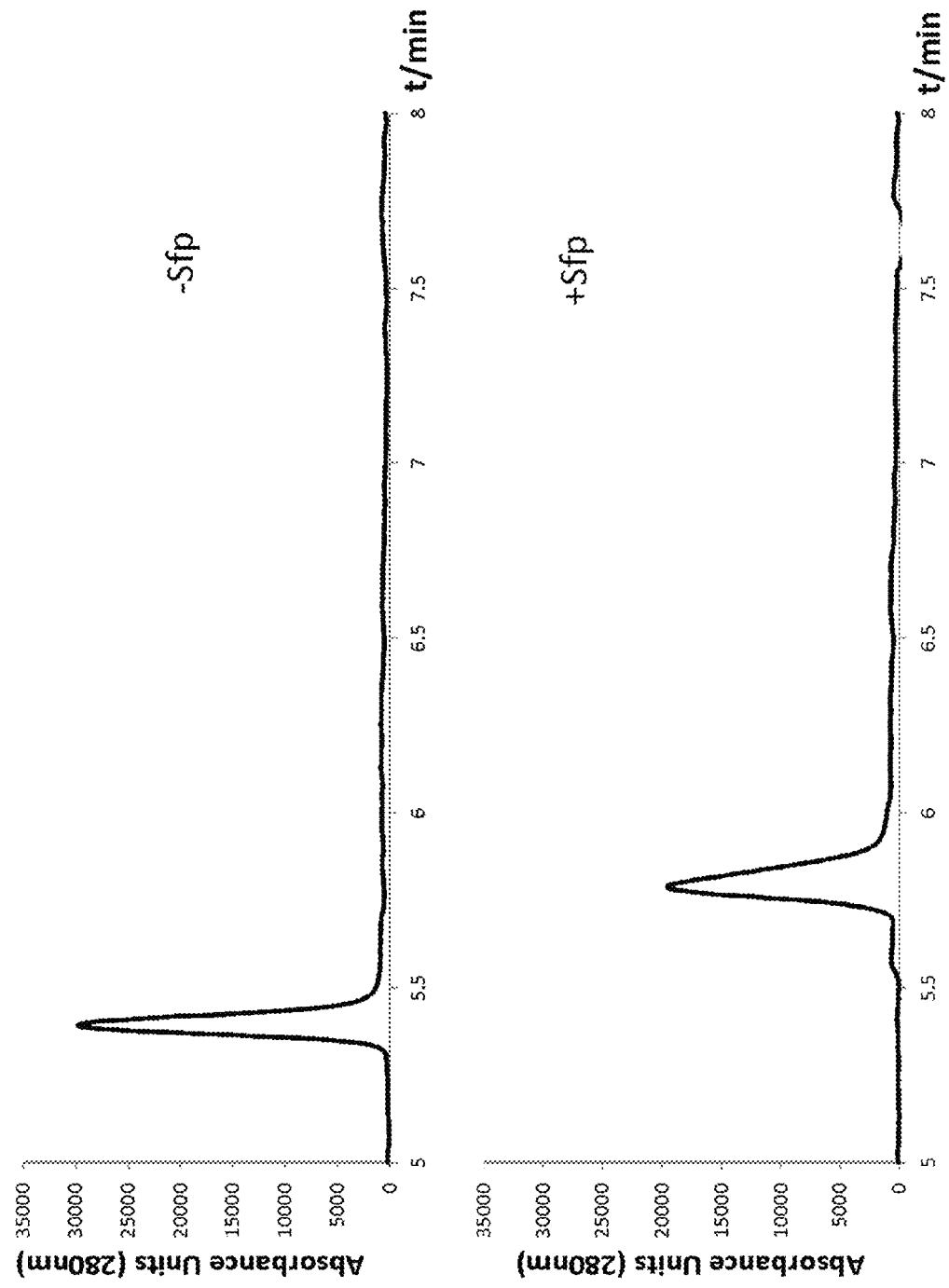
Figure 5:
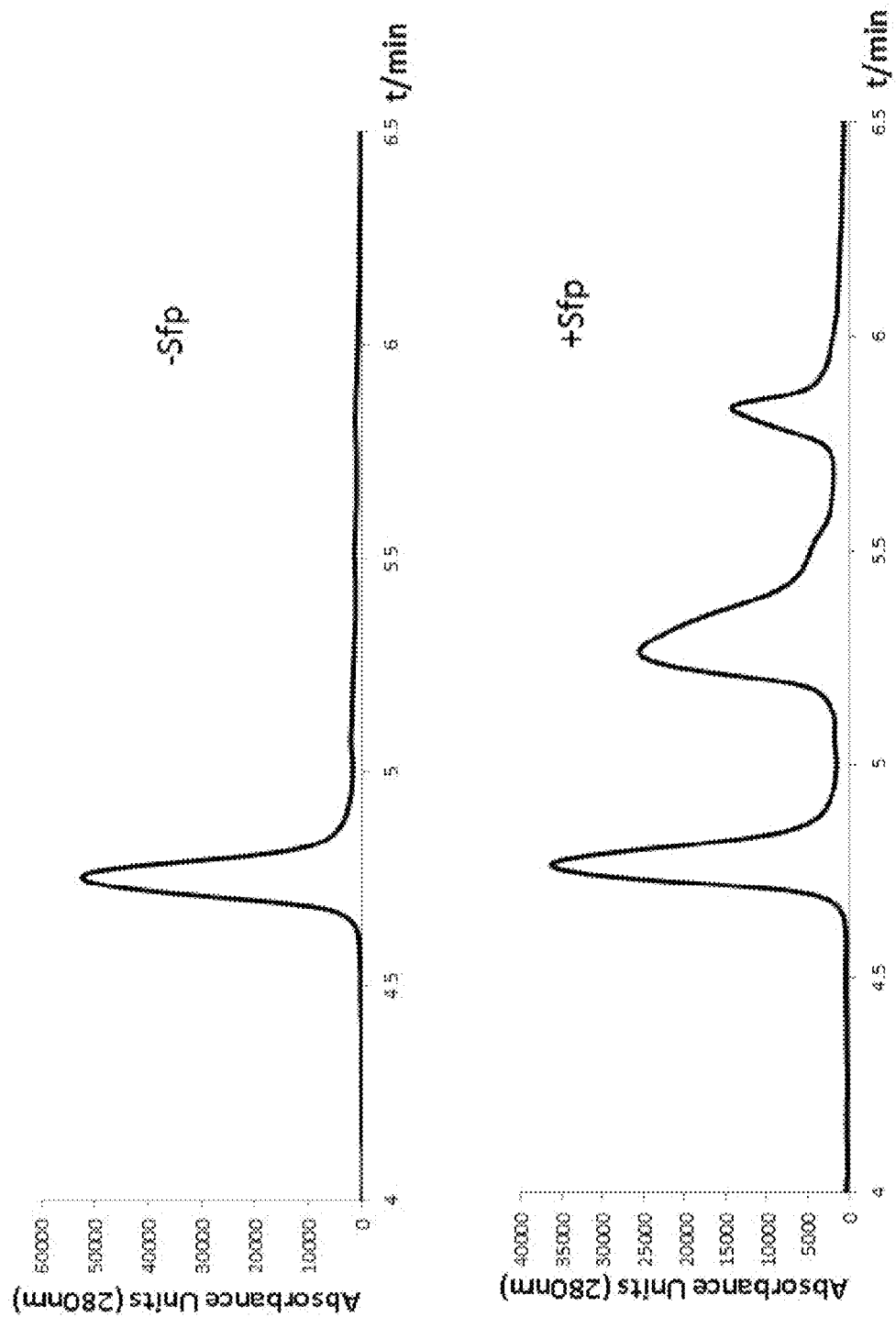

Nearly quantitative conjugation of CoA-MC-MMAF to six Trastuzumab antibodies and one 2$^{nd}$ antibody ("mAb2") against a different target with inserted S6- or ybbR-tags was accomplished by incubating reaction mixtures with Sfp as described in Example 6. HPLC of single-step conjugation reaction mixtures (Table 10) of anti-hHER2-HC-T359-GD-SLSWLLRLLN-K360 (SEQ ID NO:121, FIG. 5A), anti-hHER2-HC-E388-GDSLSWLLRLLN-N389 (SEQ ID NO:127, FIG. 5B), anti-hHER2-HC-V2-DSLEFIASKLA-Q3 (SEQ ID NO:95, FIG. 5C), anti-hHER2-HC-V2-GD-SLSWLLRLLN-Q3 (SEQ ID NO:94, FIG. 5D), anti-hHER2-HC-E388-DSLEFIASKL-N389 (SEQ ID NO:130, FIG. 5E), anti-hHER2-HC-E388-DSLEFIASKLA-N389 (SEQ ID NO: 129, FIG. 5F), and mAb2-HC-T359-GD-SLSWLLRLLN-K360 (SEQ ID NO:148, FIG. 5G) indicate near complete conversion of the tagged antibodies into an immunoconjugate with an approximate drug-to-antibody-ratio (DAR) of 2. ESI-MS of reduced conjugate samples suggest site-specific modification of only the heavy chain as designed. For anti-hHER2-LC-I2-DSLEFIASKLA-Q3 (SEQ ID NO:27, FIG. 5H), HPLC suggests only partial formation of the immunoconjugate as significant amounts of unmodified antibody (39%, retention time 4.8 mins) remain and a mixture of DAR=1 (46%, retention time 5.4 mins) and DAR=2 (16%, retention time 5.9 mins) species is observed.

TABLE 10

MS and HPLC analysis of conjugation reactions with inserted tags:

| SEQ ID NO | Antibody construct (whole antibody tested, the name represents part of the HC or LC that contains the peptide tag, the paired wildtype chain is not listed) | Observed mass (Da) | Expected mass immunoconjugate (Da) | Expected mass unmodified antibody (Da) | DAR = 2 according to HPLC |
|---|---|---|---|---|---|
| 121 | anti-hHER2-HC-T359-GDSLSWLLRLLN-K360 | 51785.20 | 51791 | 50525 | 92% |
| 127 | anti-hHER2-HC-E388-GDSLSWLLRLLN-N389 | 51786.40 | 51791 | 50525 | 97% |
| 95 | anti-hHER2-HC-V2-DSLEFIASKLA-Q3 | 51588.00 | 51598 | 50332 | 96% |
| 94 | anti-hHER2-HC-V2-GDSLSWLLRLLN-Q3 | 51780.40 | 51791 | 50525 | 100% |
| 130 | anti-hHER2-HC-E388-DSLEFIASKL-N389 | 51517.20 | 51527 | 50261 | 94% |
| 129 | anti-hHER2-HC-E388-DSLEFIASKLA-N389 | 51588.00 | 51598 | 50332 | 100% |
| 27 | anti-hHER2-LC-I2-DSLEFIASKLA-Q3 | 25878.40 | 25884 | 24618 | 16% |
| 148 | mAb2-HC-T359-GDSLSWLLRLLN-K360 | 52848.80 (major); 51600.40 (minor) | 52849 | 51597 | 95% |

Figure 6:
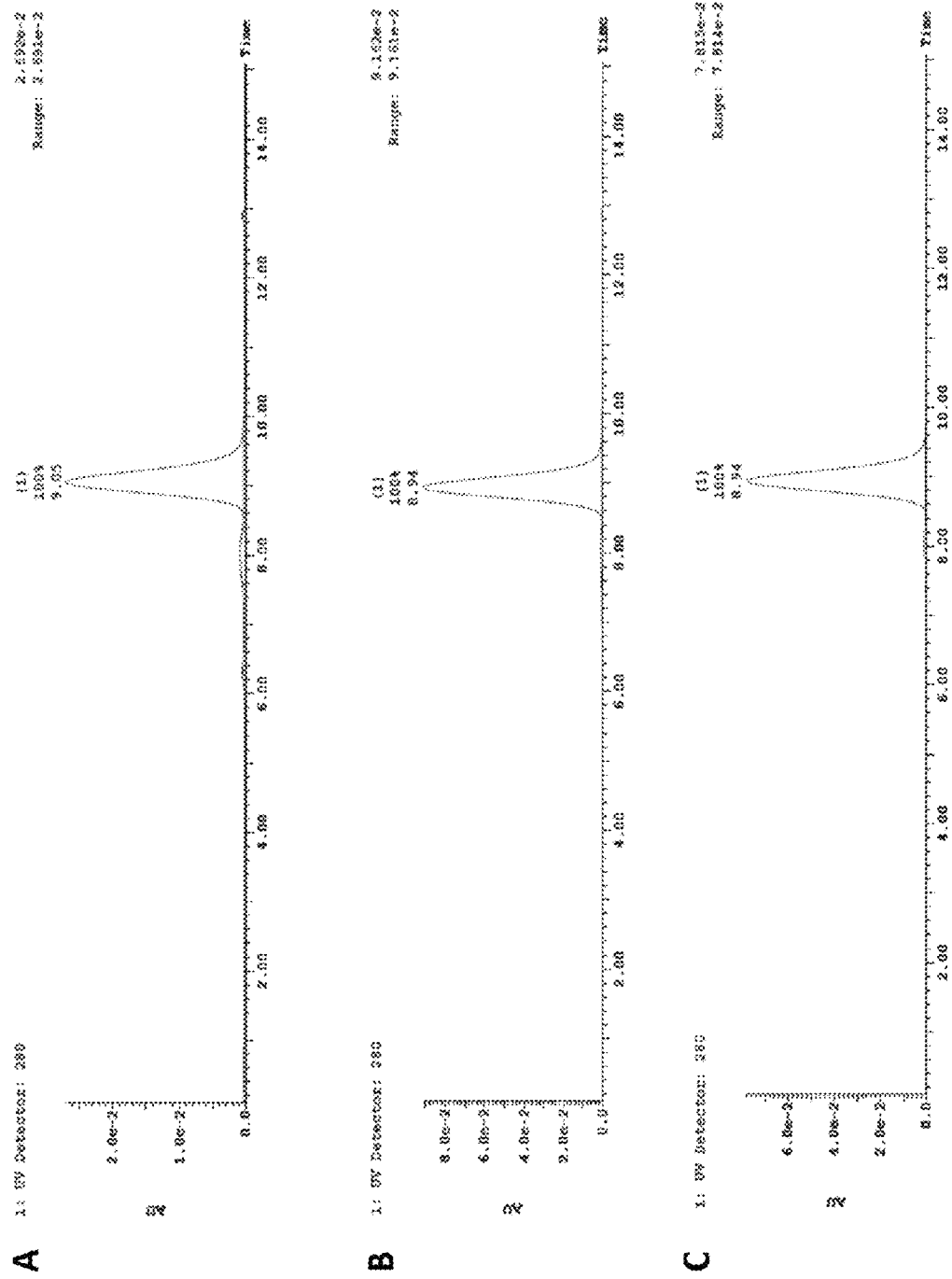
FIG. 6. Characterization of three trastuzumab immunoconjugates by analytical size-exclusion chromatography (AnSEC) exemplifies the formation of monomeric, non-aggregated ADCs. (A) AnSEC analysis of the immunoconjugate anti-hHER2-HC-V2-GDS-ppan-MC-MMAF-LSWLLRLLN-Q3 (SEQ ID NO: 1120). (B) AnSEC analysis of the immunoconjugate anti-hHER2-HC-E388-DS-ppan-MC-MMAF-LEFIASKLA-N389 (SEQ ID NO: 1122). (C) AnSEC analysis of the immunoconjugate anti-hHER2-HC-E388-DS-ppan-MC-MMAF-LEFIASKL-N389 (SEQ ID NO: 1121).

As shown in FIG. 6, the trastuzumab immunoconjugates (A) anti-hHER2-HC-V2-GDS-ppan-MC-MMAF-LSWLL-RLLN-Q3 (SEQ ID NO: 1120), (B) anti-hHER2-HC-E388-DS-ppan-MC-MMAF-LEFIASKLA-N389 (SEQ ID NO: 1122), and (C) anti-hHER2-HC-E388-DS-ppan-MC-MMAF-LEFIASKL-N389 (SEQ ID NO: 1121) were analyzed by analytical size-exclusion chromatography (AnSEC) on a Shodex PROTEIN KW-803 column. In all three cases, the ADCs were monomeric (no detectable amounts of aggregated material).

Example 8

Labeling of Constructs with Grafted Peptide Tags

Figure 7:
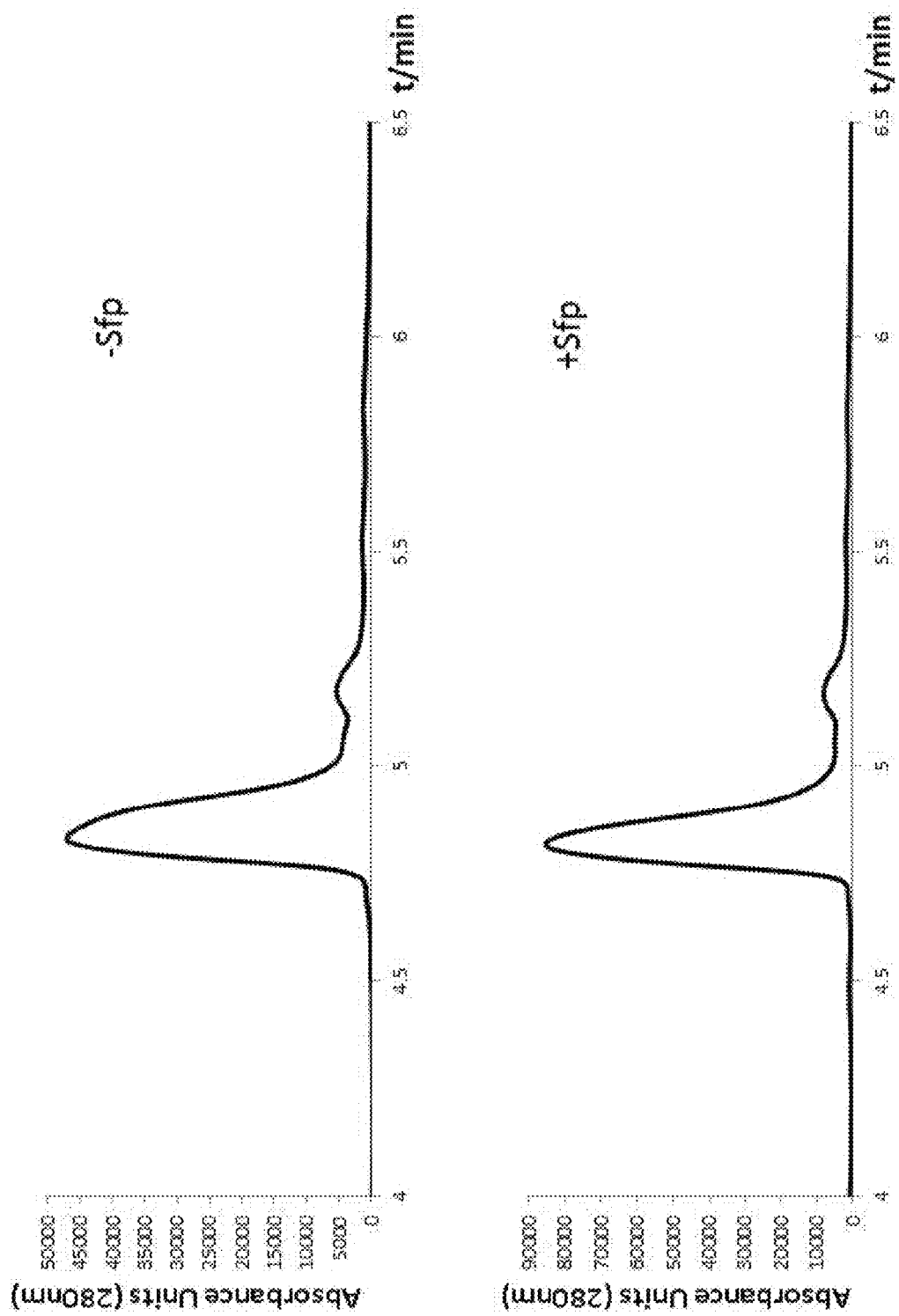
FIG. 7. HPLC characterization of unsuccessful labeling of trastuzumab with incorporation of a peptide tag at a specific location. HPLC trace indicating no conjugation between anti-hHER2-HC-S190D-S191-S192L-L193E-G194F-T195I-Q196A-T197S-Y198K-I199L (SEQ ID NO: 114) and CoA-MC-MMAF.

Single-step, in vitro Sfp-catalyzed conjugation of CoA-MC-MMAF to Trastuzumab antibody with a grafted ybbR tag was also attempted. The Sfp-catalyzed reaction of the IgG1 construct anti-hHER2-HC-S190D-S191-S192L-L193E-G194F-T195I-Q196A-T197S-Y198K-I199L (SEQ ID NO: 114) was performed as described in Example 6. HPLC (FIG. 7) and ESI-MS analysis of the reaction mixture indicate that the immunoconjugate with MMAF (expected mass conjugate: 50489 Da, expected mass unmodified antibody: 49223 Da, observed: 49216.8 Da) was not formed. Other grafted constructs also failed to react and failed to form immunoconjugates.

Example 9

Labeling of Mixed Grafting/Insertion Constructs

Figure 8:
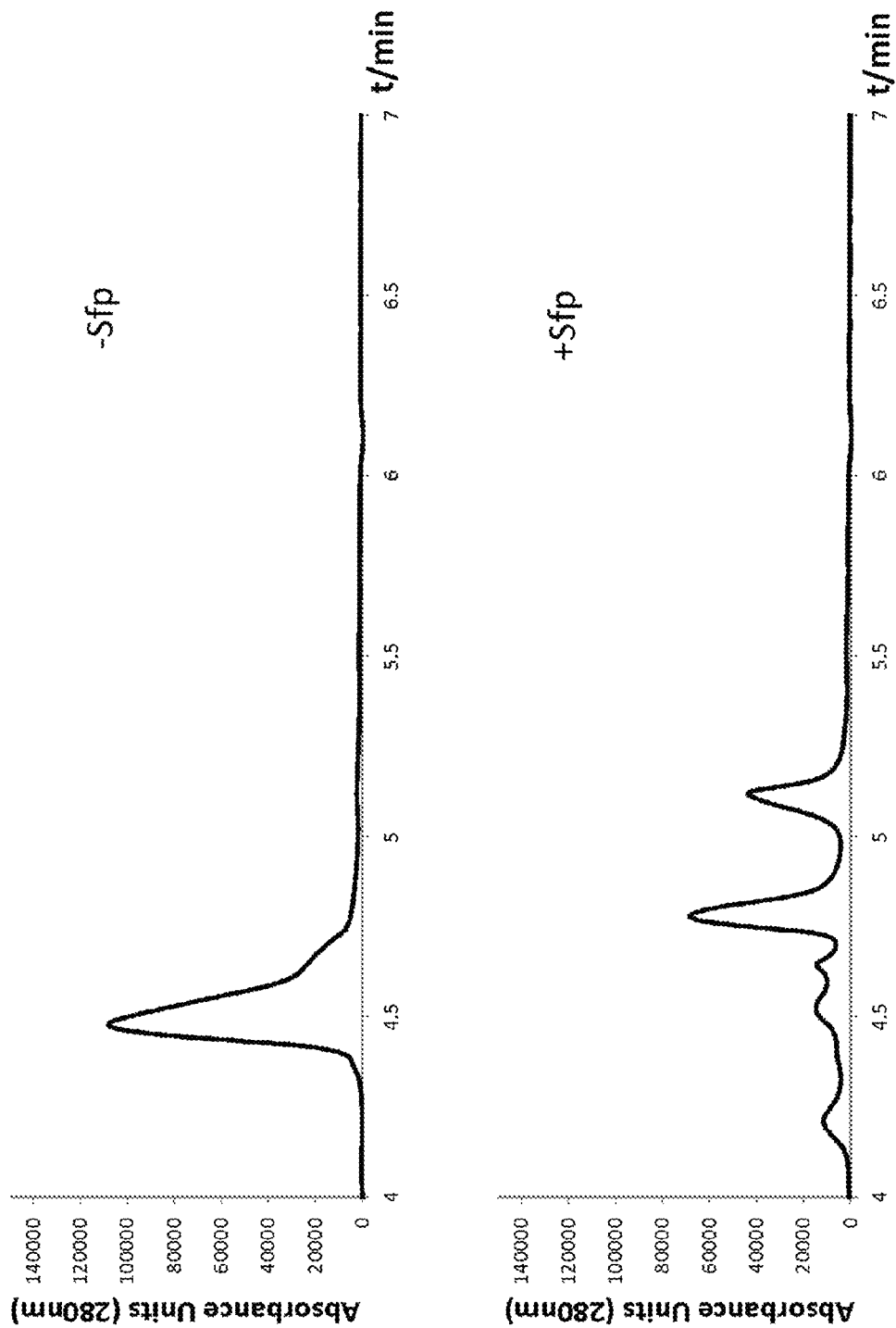
FIG. 8. HPLC characterization of the labeling of mixed grafting/insertion constructs with CoA-MC-MMAF. (A) HPLC trace indicating partial formation of the immunoconjugate anti-hHER2-HC-S63-ppan-MC-MMAF-V64L-EFIASKLA-K65 (SEQ ID NO: 1125). (B) HPLC trace indicating no formation of the immunoconjugate anti-hHER2-LC-S76D-S77-ppan-MC-MMAF-L78-EFIASKLA-Q79 (SEQ ID NO: 1126).
Figure 8:
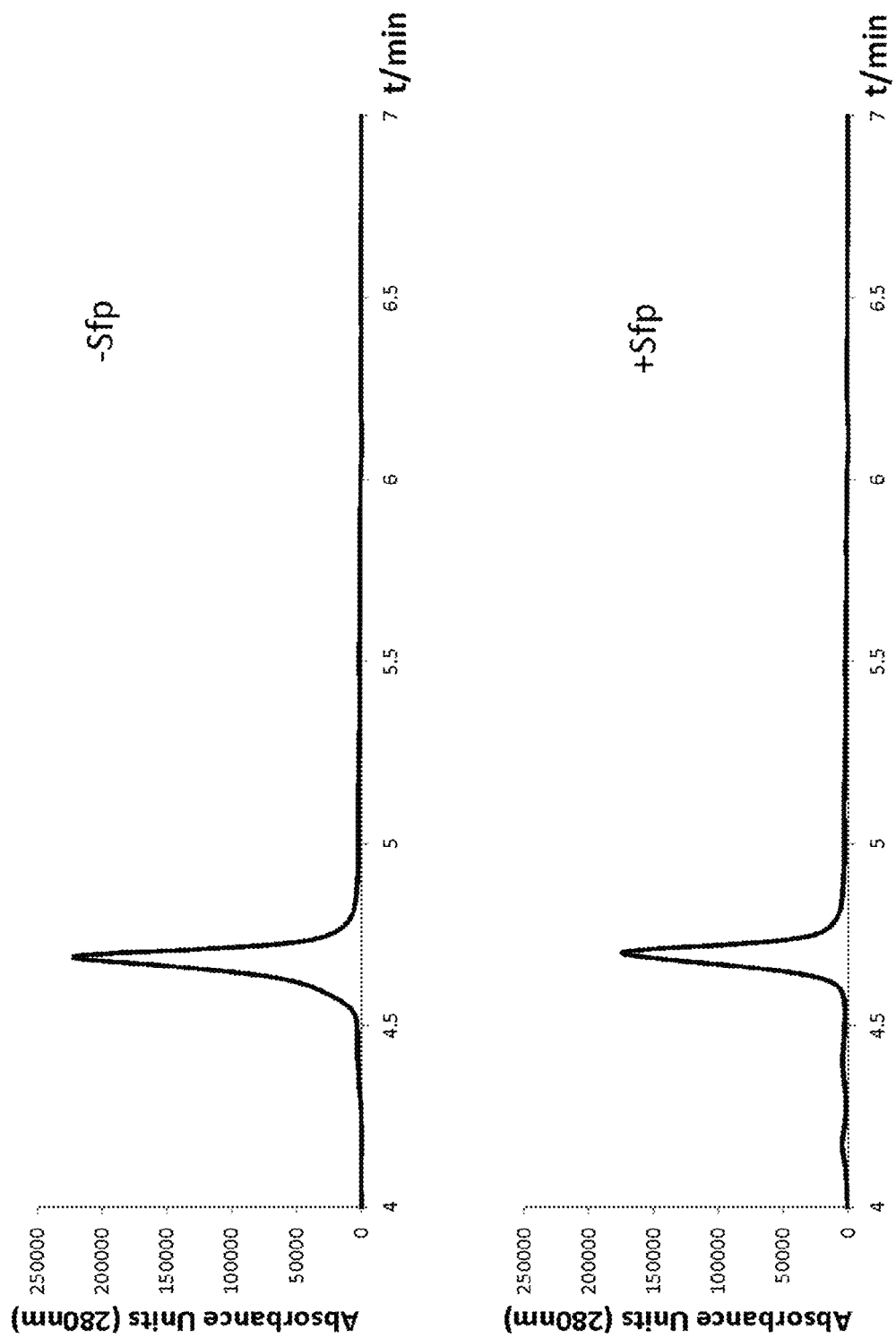

Single-step, in vitro Sfp-catalyzed conjugation of CoA-MC-MMAF to Trastuzumab antibodies with grafted/inserted S6- or ybbR-tags was also attempted. Two Trastuzumab mutants anti-hHER2-HC-V64L-EFIASKLA-K65 (SEQ ID NO: 99) and anti-hHER2-LC-S76D-S77-L78-EFIASKLA-Q79 (SEQ ID NO: 30) were reacted with CoA-MC-MMAF and Sfp as described in Example 6. While anti-hHER2-HC-V64L-EFIASKLA-K65 (SEQ ID NO: 99) is partially modified as indicated by HPLC of the reaction mixture (FIG. 8A), anti-hHER2-LC-S76D-S77-L78-EFIASKLA-Q79 (SEQ ID NO: 30)(FIG. 8B) failed to react under identical conditions (Table 11).

Example 10

Labeling with Fluorescent Dyes

To extend enzymatic antibody labeling beyond the site-specific attachment of cytotoxins, we demonstrate the feasibility of Sfp-catalysis to generate antibody-fluorophore conjugates. This example represents two Sfp-catalyzed conjugations of CoA-tetramethylrhodamine (CoA-TMR) to Trastuzumab antibodies with either grafted or inserted S6 tags performed as described in Example 6. HPLC traces of reaction mixtures were monitored at both 280 nm and 555 nm (FIG. 9). The latter wavelength is near the absorption maximum of the TMR dye (~550 nm). Furthermore, the data of the deconvoluted mass spectra of the antibody-fluorophore conjugates is summarized in Table 12.

For the anti-hHER2-HC-P189G-S190D-S191-S192L-L193S-G194W-T195L (SEQ ID NO: 109) that contains a truncated grafted S6 tag, conjugation resulted primarily in the formation of a two-dye per antibody conjugate (FIG. 9A). Likewise, the anti-hHER2-HC-T359-GDSLSWLL-RLLN-K360 (SEQ ID NO: 121) with a full-length S6 tag inserted between residue T359 and K360 showed predominantly conjugation of two dye molecules to each antibody (FIG. 9B). The results illustrate the S6 tags can be used for conjugation of fluorescent labeling of modified antibodies.

TABLE 11

ESI-MS results of conjugation reactions with mixed grafted/inserted tags:

| SEQ ID NO | Antibody construct (whole antibody tested, the name represents part of the HC or LC that contains the peptide tag, the paired wildtype chain is not listed) | Observed mass (Da) | Expected mass immunoconjugate (Da) | Expected mass unmodified antibody (Da) | DAR = 2 according to HPLC |
|---|---|---|---|---|---|
| 99 | anti-hHER2-HC-V64L-EFIASKLA-K65 | 51287.20 | 51297 | 50031 | 32% |
| 30 | anti-hHER2-LC-S76D-S77-L78-EFIASKLA-Q79 | 24324.80 | 25597 | 24331 | 0% |

TABLE 12

ESI-MS results of the conjugation reactions with a fluorescent dye:

| SEQ ID NO | Antibody construct (whole antibody tested, the name represents part of the HC or LC that contains the peptide tag, the paired wildtype chain is not listed) | Observed mass (Da) | Expected mass fluorophore conjugate (Da) | Expected mass unmodified antibody (Da) |
|---|---|---|---|---|
| 109 | anti-hHER2-HC-P189G-S190D-S191-S192L-L193S-G194W-T195L | 50177.20 | 50180 | 49286 |
| 121 | anti-hHER2-HC-T359-GDSLSWLLRLLN-K360 | 51422.00 | 51419 | 50525 |

Example 11

Figure 10:
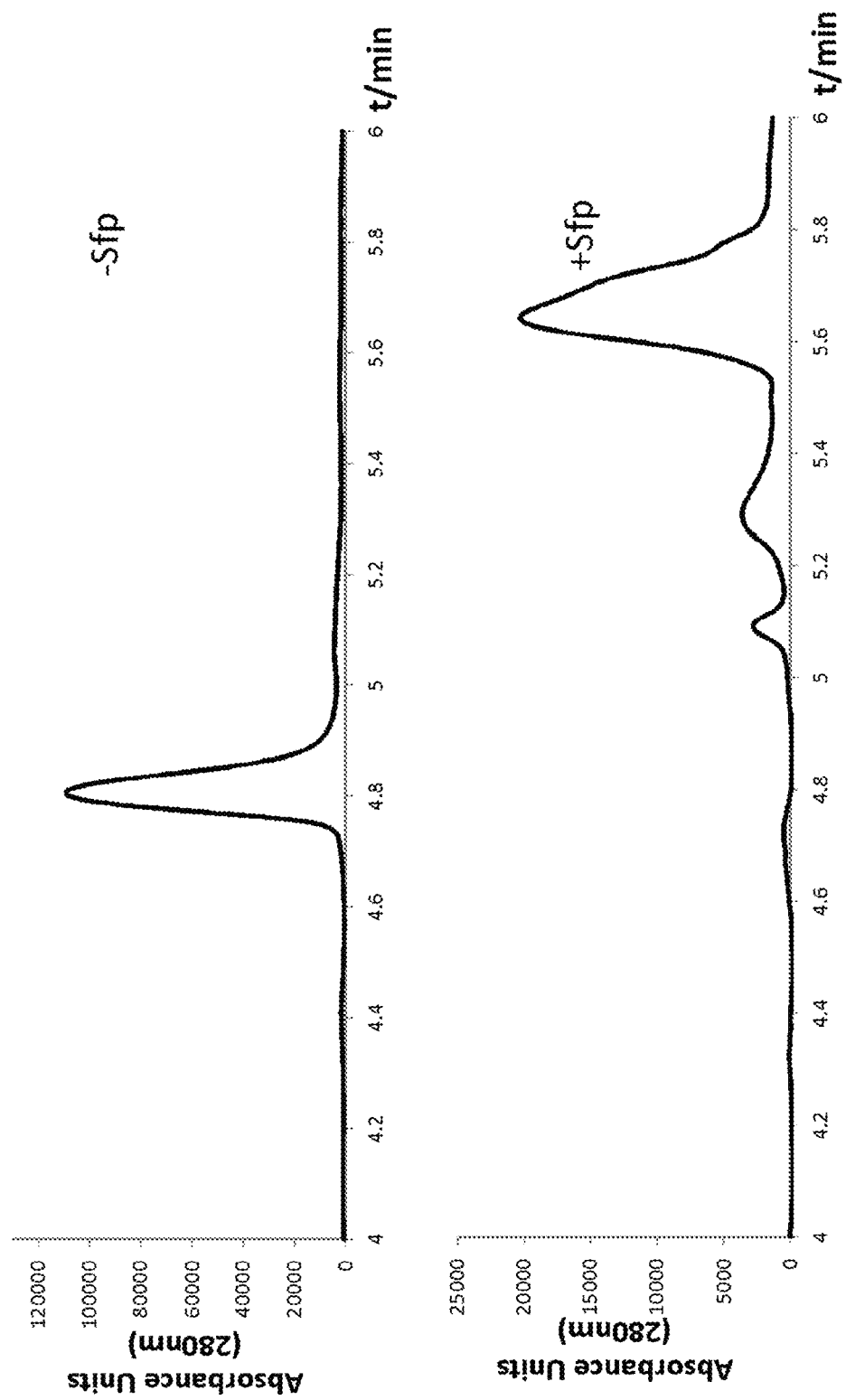
FIG. 10. HPLC characterization of antibody labeling with hydrolyzed maleimido- or bromoacetyl thioether-linked cytotoxins. (A) HPLC trace confirming the near quantitative conjugation of maleimide-ring-opened CoA-MC-MMAF to anti-hHER2-HC-T359-GDSLSWLLRLLN-K360 (SEQ ID NO: 121). (B) HPLC trace confirming the near quantitative conjugation of CoA-Ac-Ahx-MMAF to anti-hHER2-HC-T359-GDSLSWLLRLLN-K360 (SEQ ID NO: 121).

Near Quantitative Labeling with Cytotoxins Linked Through Thioether or Hydrolyzed Maleimide Linkage Although not observed for conjugates of the invention, maleimide-linked payloads may undergo deconjugation in plasma via maleimide exchange with reactive thiols of albumin, glutathione, and cysteine (Alley et al., *Bioconjugate Chem.* 2008, 19, 759-765). Maleimide-based conjugates can be stabilized through chemical ring-opening of the maleimidocaproyl linkage (see, Shen et al., *Nature Biotech.* 30:184-189 (2012)). To test this hydrolysis procedure, the respective ADC of anti-hHER2-HC-T359-GDSLSWLL-RLLN-K360 (SEQ ID NO: 121) was prepared using CoA-open-ring-MC-MMAF. Moreover, to test alternative thiol-reactive chemistries, we attached the MMAF cytotoxin to the terminal thiol of CoA via an acetamide-based thioether linkage resulting in CoA-Ac-Ahx-MMAF (see, Alley et al., Bioconj. Chem. 19:759-765 (2008)). The ESI-MS and HPLC results of these enzymatic conjugation reactions (according to the protocol described in Example 6) are summarized in Table 13. Near quantitative labeling with DAR=2 was observed for anti-hHER2-HC-T359-GD-SLSWLLRLLN-K360 (SEQ ID NO: 121) reacted with CoA-open-ring-MC-MMAF (FIG. 10A) and anti-hHER2-HC-T359-GDSLSWLLRLLN-K360 (SEQ ID NO: 121) reacted with CoA-Ac-Ahx-MC-MMAF (FIG. 10B).

TABLE 13

ESI-MS results of the conjugation reactions with alternative linkers:

| SEQ ID NO of the antibody (whole antibody tested, the name represents part of the HC or LC that contains the peptide tag, the paired wildtype chain is not listed) | CoA substrate | Observed mass (Da) | Expected mass immunoconjugate (Da) | Expected mass unmodified antibody (Da) | DAR = 2 according to HPLC |
|---|---|---|---|---|---|
| 121 | maleimide-ring-opened CoA-MC-MMAF | 51802.00 | 51809 | 50525 | 85% |
| 121 | CoA-Ac-Ahx-MMAF | 51742.40 | 51750 | 50525 | 80% |

Example 12

Near Quantitative Labeling with Cytotoxin with Cleavable Linker

Figure 11:
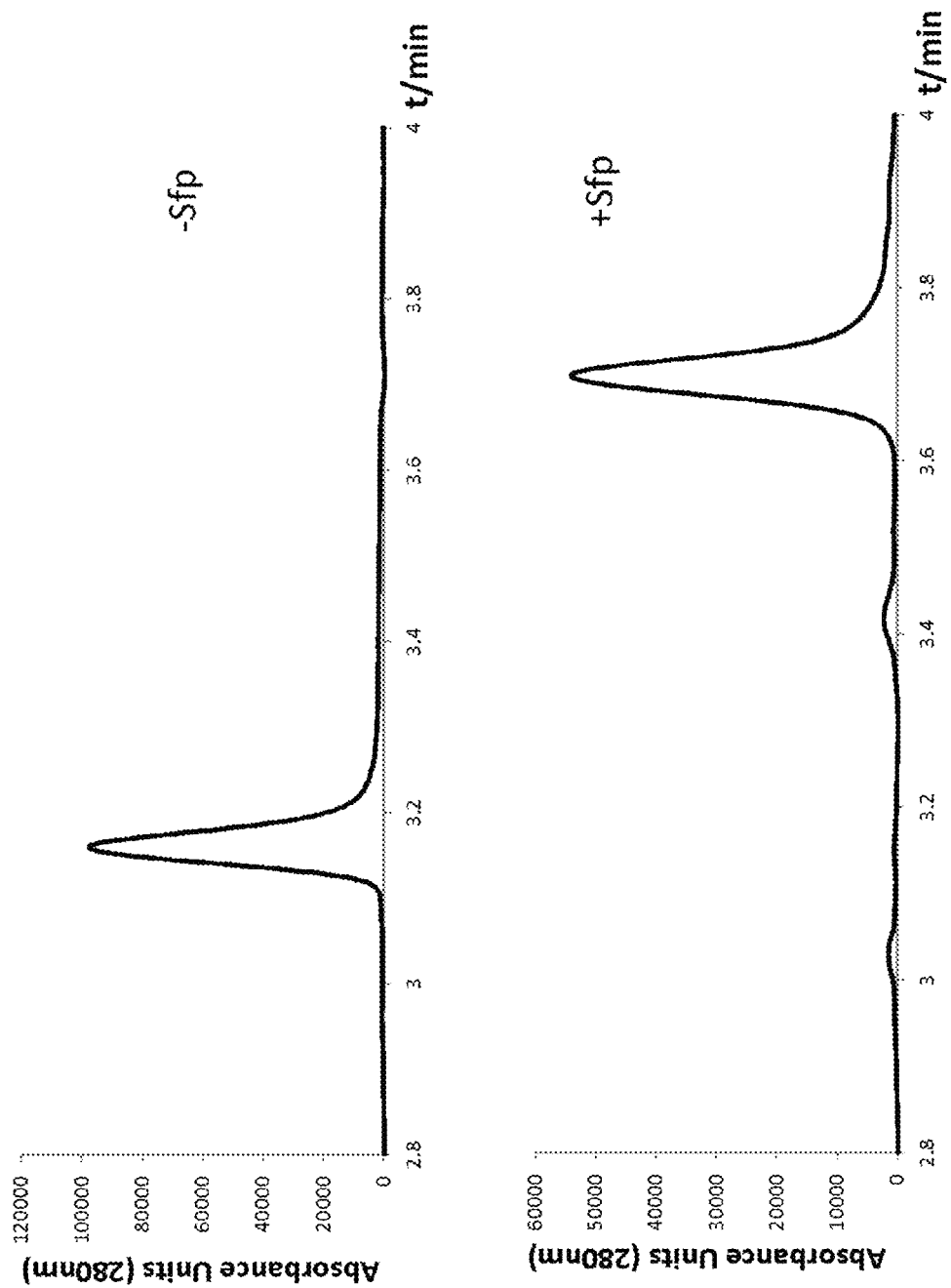
FIG. 11. HPLC characterization of antibody labeling with cytotoxins connected via a cleavable linker. (A) HPLC trace confirming the near quantitative conjugation of CoA-MC-Val-Cit-PABC-MMAF to anti-hHER2-HC-T359-GD-SLSWLLRLLN-K360 (SEQ ID NO: 121). (B) HPLC trace confirming the near quantitative conjugation of CoA-MC-Val-Cit-PABC-MMAF to anti-hHER2-HC-E388-GD-SLSWLLRLLN-N389 (SEQ ID NO: 127).

To demonstrate the labeling of peptide-tagged IgGs with cytotoxins that are attached via cleavable linkers, we conjugated CoA-MC-Val-Cit-PABC-MMAF containing the cathepsin B-sensitive valine-citrulline linker to either anti-hHER2-HC-T359-GDSLSWLLRLLN-K360 (SEQ ID NO: 121)(FIG. 11A) or anti-hHER2-HC-E388-GDSLSWLL-RLLN-N389 (SEQ ID NO: 127) (FIG. 11B) in the presence of Sfp. HPLC and ESI-MS results of this single-step enzymatic conjugation are summarized in Table 14 and indicate near quantitative labeling with a DAR=2 for both tag positions.

TABLE 14

ESI-MS results of the conjugation reactions with CoA-MC-Val-Cit-PABC-MMAF:

| SEQ ID NO | Antibody construct | Observed mass (Da) | Expected mass immunoconjugate (Da) | Expected mass unmodified antibody (Da) | DAR = 2 according to HPLC |
|---|---|---|---|---|---|
| 121 | anti-hHER2-HC-T359-GDSLSWLL RLLN-K360 | 52189.60 | 52196 | 50525 | 91% |
| 127 | anti-hHER2-HC-E388-GDSLSWLL RLLN-N389 | 52188.40, 51412.40 | 52196 | 50525 | 95% |

Example 13

Optimization of Labeling Reaction as a Function of pH

The purpose of this experiment was to determine the optimal pH range for Sfp-catalyzed conjugation of CoA substrates to peptide-tagged antibodies. In three experiments, 2.5 μM of anti-hHER2-HC-E388-GDSLSWLL-RLLN-N389 (SEQ ID NO: 127) or 2.5 μM of anti-hHER2-HC-T359-GDSLSWLLRLLN-K360 (SEQ ID NO: 121) were reacted with 10 μM of CoA-MC-MMAF in the presence of 0.25 μM of Sfp (for anti-hHER2-HC-E388-GDSLSWLLRLLN-N389 (SEQ ID NO: 127)) or 1.0 μM of Sfp (for anti-hHER2-HC-T359-GDSLSWLLRLLN-K360 (SEQ ID NO: 121)), and the pH was titrated from pH 5.0 to 10.0. In order to cover this pH range, five buffers were utilized: 75 mM sodium acetate buffer for pH 5.0; 75 mM MES buffer for pH 5.5, 6.0, and 6.5; 75 mM HEPES buffer for pH 7.0, 7.5, and 8.0; 75 mM sodium borate buffer for pH 9.0; 75 mM sodium carbonate buffer for pH 10.0. All buffers were supplemented with 12.5 mM of $MgCl_2$ to ensure enzyme activity. The pH titration series was performed at 23° C. for 25 to 35 min in a volume of 100 μL for each reaction. After quenching the enzymatic reaction by the addition of 30 μL of 4% (v/v) trifluoroacetic acid (TFA), reaction mixtures were analyzed by HPLC at 280 nm as summarized in Table 15.

TABLE 15

HPLC results of labeling reactions as a function of pH:

| SEQ ID NO | Antibody construct (whole antibody tested, the name represents part of the HC or LC that contains the peptide tag, the paired wildtype chain is not listed) | pH value | DAR = 0 | DAR = 1 | DAR = 2 |
|---|---|---|---|---|---|
| 127 | anti-hHER2-HC-E388-GDSLSWLLRLLN-N389 | 5.0 | 100%; 100% | 0%; 0% | 0%; 0% |
| 121 | anti-hHER2-HC-T359-GDSLSWLLRLLN-K360 | | 100% | 0% | 0% |
| 127 | anti-hHER2-HC-E388-GDSLSWLLRLLN-N389 | 5.5 | 100% | 0% | 0% |
| 127 | anti-hHER2-HC-E388-GDSLSWLLRLLN-N389 | 6.0 | 88%; 90% | 12%; 10% | 0%; 0% |
| 121 | anti-hHER2-HC-T359-GDSLSWLLRLLN-K360 | | 100% | 0% | 0% |
| 127 | anti-hHER2-HC-E388-GDSLSWLLRLLN-N389 | 6.5 | 68% | 23% | 9.2% |
| 127 | anti-hHER2-HC-E388-GDSLSWLLRLLN-N389 | 7.0 | 25%; 26% | 48%; 44% | 28%; 31% |
| 121 | anti-hHER2-HC-T359-GDSLSWLLRLLN-K360 | | 77% | 23% | 0% |
| 127 | anti-hHER2-HC-E388-GDSLSWLLRLLN-N389 | 7.5 | 12% | 41% | 47% |
| 127 | anti-hHER2-HC-E388-GDSLSWLLRLLN-N389 | 8.0 | 7.7%; 11% | 36%; 36% | 56%; 52% |
| 121 | anti-hHER2-HC-T359-GDSLSWLLRLLN-K360 | | 52% | 37% | 11% |
| 127 | anti-hHER2-HC-E388-GDSLSWLLRLLN-N389 | 9.0 | 12% | 31% | 57% |
| 121 | anti-hHER2-HC-T359-GDSLSWLLRLLN-K360 | | 32% | 46% | 23% |
| 127 | anti-hHER2-HC-E388-GDSLSWLLRLLN-N389 | 10.0 | 100% | 0% | 0% |
| 121 | anti-hHER2-HC-T359-GDSLSWLLRLLN-K360 | | 53% | 36% | 11% |

Figure 12:
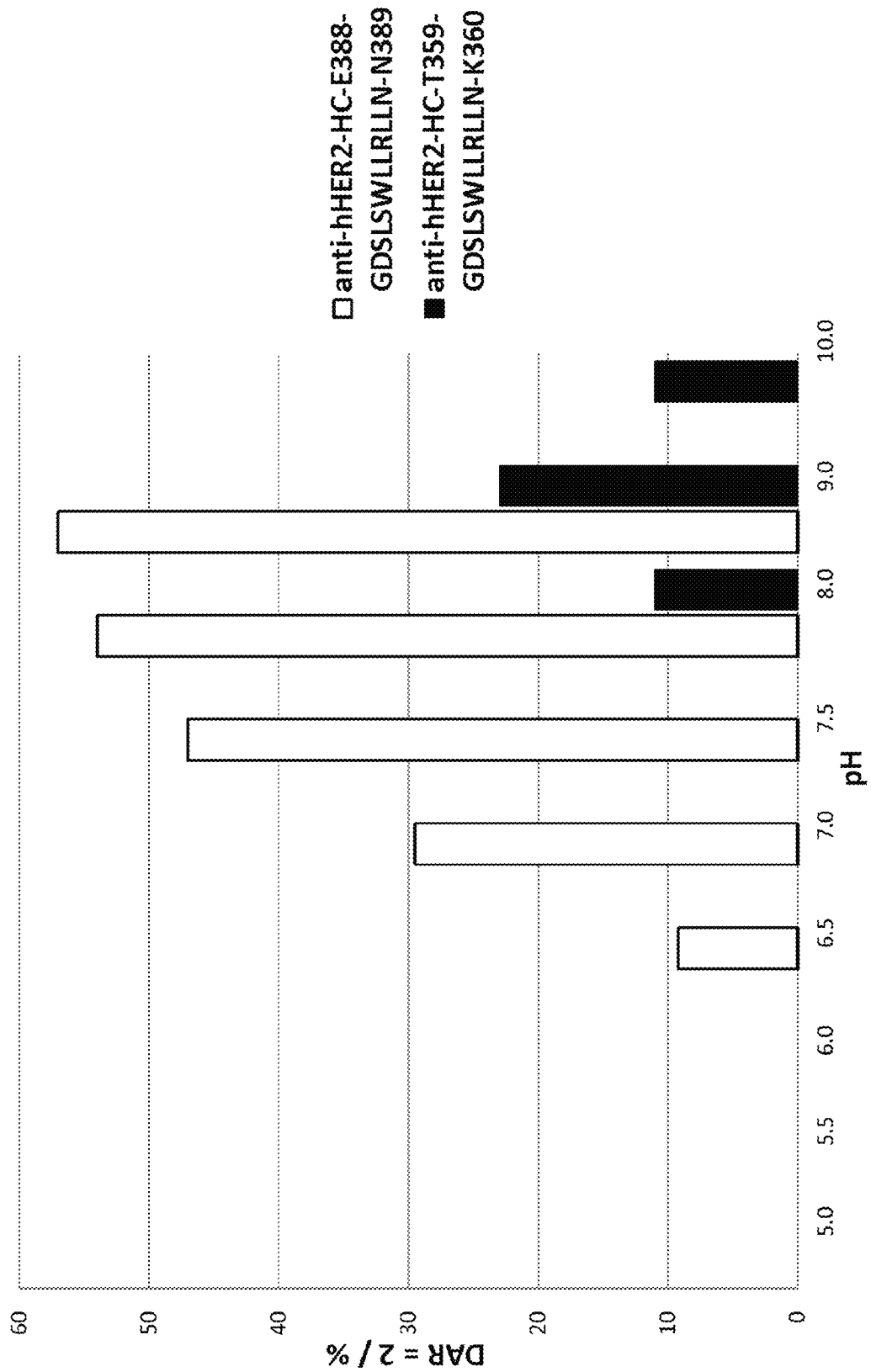
FIG. 12. Optimization of 4'-phosphopantetheinyl transferase (PPTase)-catalyzed ADC formation as a function of pH. The bar graph representation shows the amount of generated ADC with a drug-to-antibody ratio (DAR) of 2 as a function of pH. The data is based on the HPLC analysis (280 nm) of the reaction of CoA-MC-MMAF with either anti-hHER2-HC-T359-GDSLSWLLRLLN-K360 (SEQ ID NO: 121) or anti-hHER2-HC-E388-GDSLSWLLRLLN-N389 (SEQ ID NO: 127) at a pH range of 5.0 to 10.0.

The HPLC results indicate that the pH range 8 to 9 is optimal for the conjugation of CoA-MC-MMAF to peptide-tagged Trastuzumab. In this pH range, the lowest amount of uncoupled antibody (DAR=0) and the highest amount of bi-conjugated ADC (DAR=2) could be detected by HPLC. Furthermore, plotting the percentage of ADC with a DAR of 2 against the pH (FIG. 12) indicates that the pH optimum is independent of the insertion site of the S6 tag for the two sites tested.

Example 14

Optimization of Labeling Reaction as a Function of Enzyme Concentration

Figure 13:
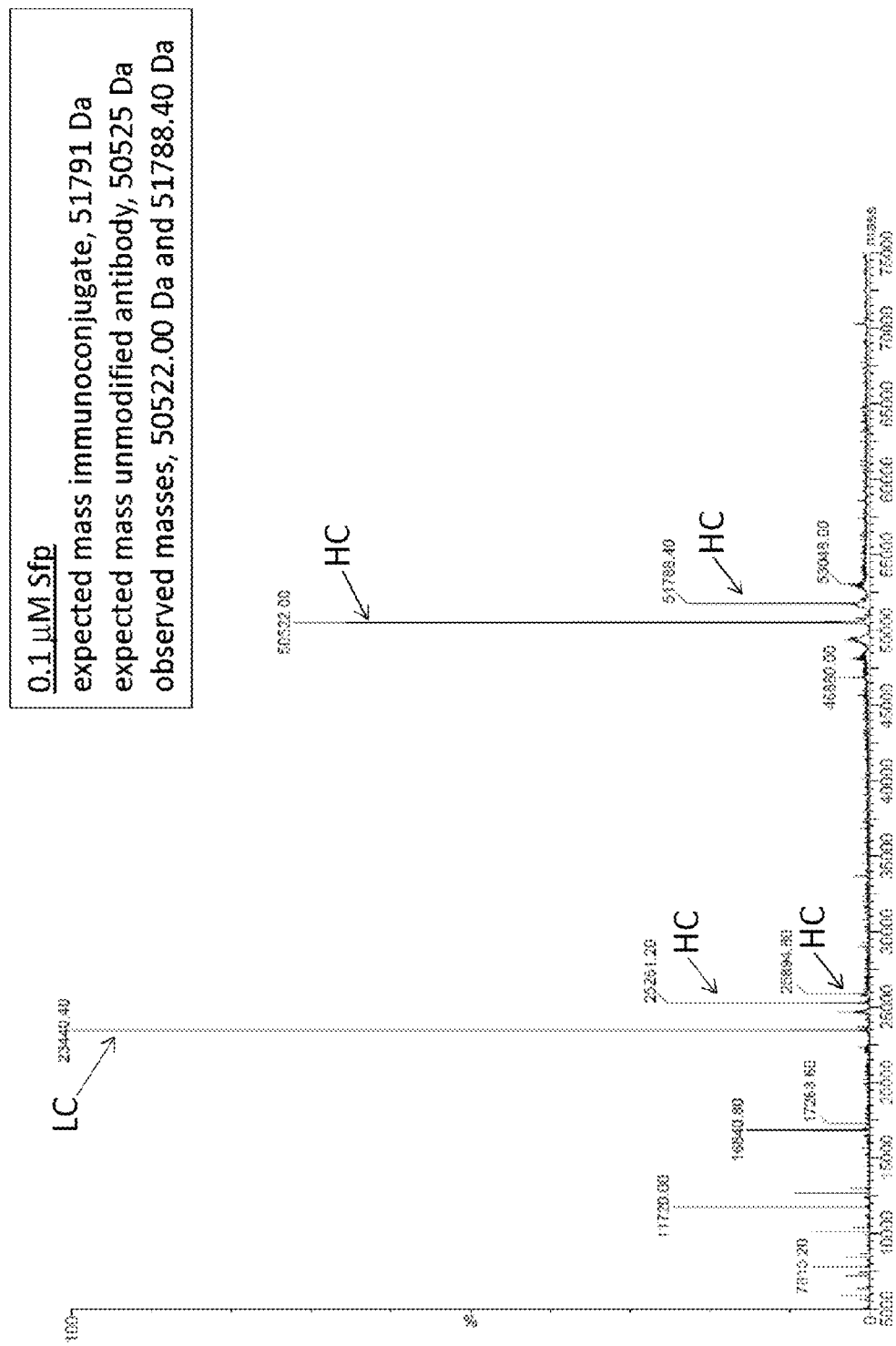
FIG. 13. Optimization of conjugation reaction as a function of Sfp enzyme concentration in 50 mM HEPES buffer (pH 7.5) containing 2.5 µM antibody, 50 µM CoA-MC-MMAF, and 10 mM $MgCl_2$ (37° C., 16 hours). (A) Deconvoluted mass spectrum showing primarily unconjugated anti-hHER2-HC-E388-GDSLSWLLRLLN-N389 (SEQ ID NO: 127) at an Sfp concentration of 0.1 µM. (B) Deconvoluted mass spectrum showing near quantitative ADC formation of anti-hHER2-HC-E388-GDS-ppan-MC-MMAF-LSWLLRLLN-N389 (SEQ ID NO: 1118) at an Sfp concentration of 0.25 µM. (C) Deconvoluted mass spectrum showing near quantitative ADC formation of anti-hHER2-HC-E388-GDS-ppan-MC-MMAF-LSWLLRLLN-N389 (SEQ ID NO: 1118) at an Sfp concentration of 0.5 µM.
Figure 13:
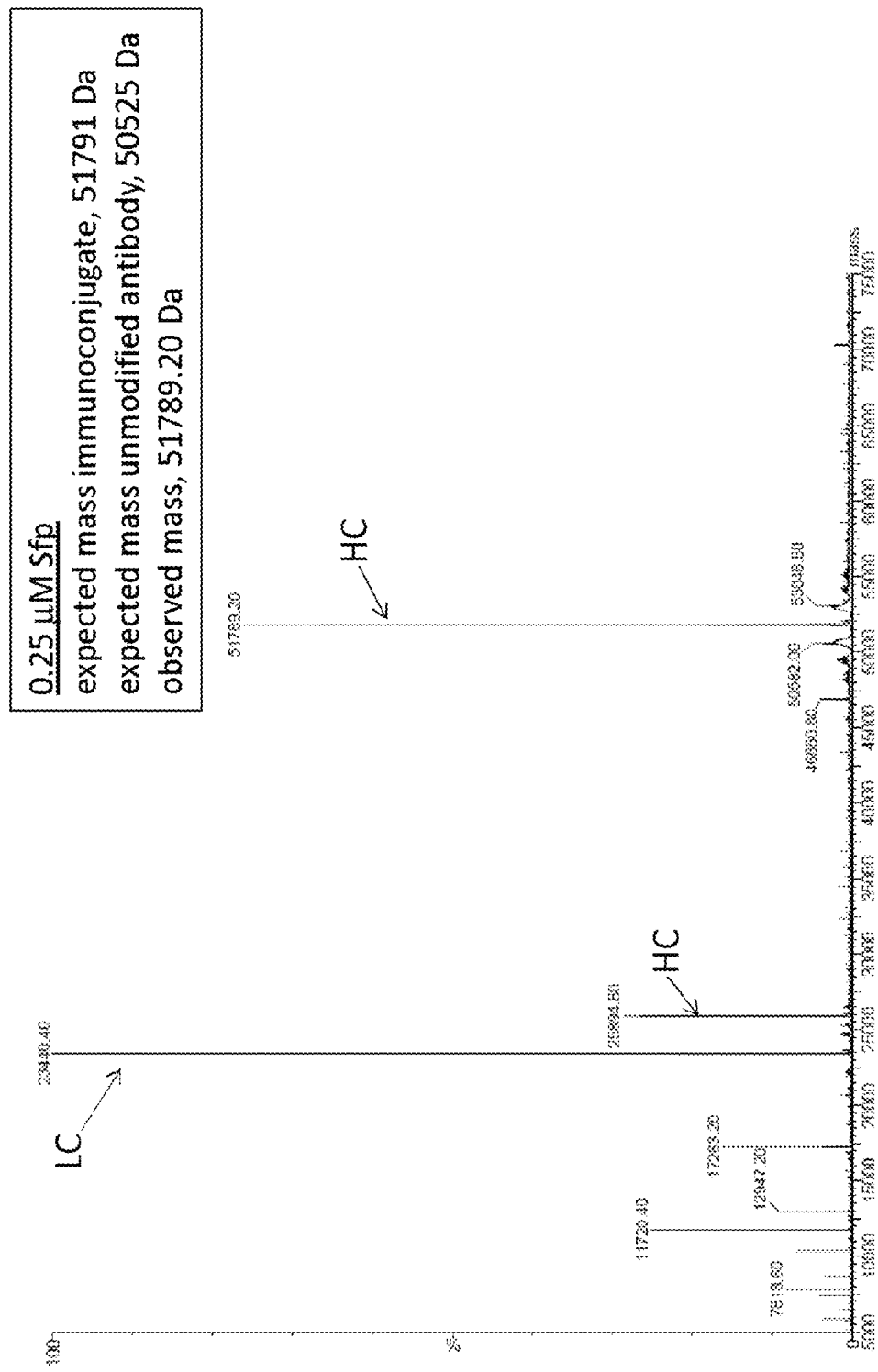
Figure 13:
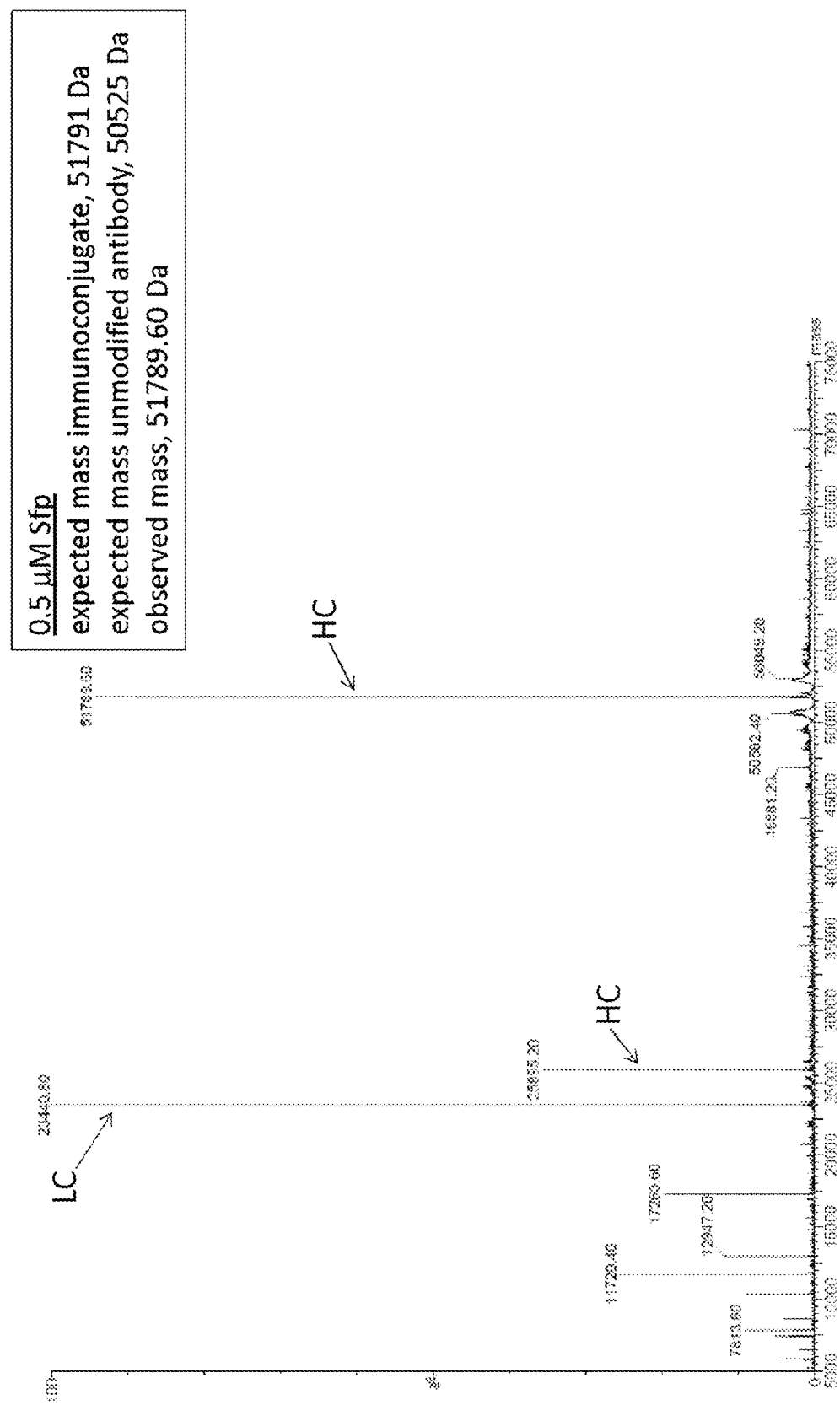

To test the amount of Sfp required for efficient enzymatic conjugation, 2.5 µM of anti-hHER2-HC-E388-GD-SLSWLLRLLN-N389 (SEQ ID NO: 127) was incubated at 37° C. for 16 hours with 50 µM CoA-MC-MMAF in 50 mM HEPES buffer (pH 7.5) supplemented with 10 mM $MgCl_2$ in the presence of no Sfp enzyme or 0.1, 0.25, 0.5, 1, 2.5, 5 or 10 µM Sfp enzyme. After 16 hours, aliquots of the reaction were analyzed by ESI-MS. For Sfp concentrations of 0.1 µM, mainly non-conjugated modified antibody is detectable by ESI-MS (FIG. 13A). Quantitative conjugation was obtained for all Sfp concentrations equal (FIG. 13B) or greater than 0.25 µM, such as 0.5 µM of Sfp (FIG. 13C).

Example 15

Optimization of Labeling Reaction as a Function of CoA Analog

To determine the minimal concentration of CoA substrate that would be required for quantitative labeling of an peptide-tagged IgG1 antibody, 2.5 µM anti-hHER2-HC-E388-GDSLSWLLRLLN-N389 (SEQ ID NO: 127) was incubated with 0.25 µM or 1.0 µM Sfp in 75 mM Tris buffer (pH 8.0) containing 12.5 mM $MgCl_2$ and supplemented with CoA-MC-MMAF at the following concentrations: 2.5, 5, 7.5, 10, 15, 25, and 50 µM. The reaction was allowed to proceed for 13 hours at 23° C. and then quenched with 30 µL of 4% (v/v) trifluoroacetic acid (TFA). According to HPLC analysis (FIGS. 14A and 14B, Table 16), nearly quantitative antibody conjugation was achieved for all CoA-MC-MMAF concentrations equal or higher than 7.5 µM. The degree of labeling was almost independent on the Sfp concentration, with 86% DAR 2 species observed at 0.25 µM Sfp and 92% DAR 2 species observed at 1.0 µM Sfp.

TABLE 16

HPLC results of labeling reactions as a function of CoA concentration:

| CoA-MC-MMAF (µM) | Sfp (µM) | Retention time | | |
|---|---|---|---|---|
| | | 4.9 min DAR = 0 | 5.3 min DAR = 1 | 5.7 min DAR = 2 |
| 50 | 0.25 | 3.8% | 7.1% | 89% |
| 25 | 0.25 | 3.7% | 7.0% | 89% |
| 15 | 0.25 | 3.2% | 6.9% | 90% |
| 10 | 0.25 | 3.9% | 7.2% | 89% |
| 7.5 | 0.25 | 5.0% | 8.6% | 86% |
| 5 | 0.25 | 5.7% | 20.5% | 74% |
| 2.5 | 0.25 | 28% | 48.3% | 24% |
| 50 | 1.0 | — | 7.1% | 93% |
| 25 | 1.0 | — | 6.3% | 94% |
| 15 | 1.0 | — | 5.7% | 94% |
| 10 | 1.0 | — | 5.7% | 94% |

TABLE 16-continued

HPLC results of labeling reactions as a function of CoA concentration:

| CoA-MC-MMAF (µM) | Sfp (µM) | Retention time | | |
|---|---|---|---|---|
| | | 4.9 min DAR = 0 | 5.3 min DAR = 1 | 5.7 min DAR = 2 |
| 7.5 | 1.0 | 1.0% | 6.7% | 92% |
| 5 | 1.0 | 2.8% | 24% | 73% |
| 2.5 | 1.0 | 31% | 48% | 21% |

To determine the aggregation state of the anti-hHER2-HC-E388-GDS-MC-MMAF-LSWLLRLLN-N389 (SEQ ID NO: 1129) immunoconjugate, 5.6 mg of anti-hHER2-HC-E388-GDSLSWLLRLLN-N389 (SEQ ID NO: 127) (2.5 µM) were reacted with 40 µM CoA-MC-MMAF in the presence of 1 µM Sfp in 50 mM HEPES buffer (pH 7.5) supplemented with 10 mM $MgCl_2$. After incubation at 23° C. for 3 days, the reaction mixture was purified on a Sephacryl 100-HR size-exclusion column (Sigma). After confirming quantitative conjugation by ESI-MS (observed mass, 51786.40 Da; expected mass immunoconjugate, 51791 Da; expected mass unmodified antibody, 50525 Da), the quaternary structure of the respective ADC was analyzed on a Tricorn S200 column (Agilent). The ADC was primarily monomeric (98%) and contained trace amounts of an oligomerized species (2%).

Example 16

Thermal Stability of S6 Antibodies and ADCs

To examine the thermal stability of peptide-tagged immunoconjugates, purified ADC samples were measured by differential scanning fluorometry (DSF) (Table 17) or differential scanning calorimetry (DSC) (Table 18). Samples were diluted to a final concentration of 0.25 mg/mL (1.67 mM) in PBS, pH 7.4. For DSF, SYPRO Orange gel stain (Sigma) was added to a final concentration of 5× as the tracer to indicate thermal unfolding of the ADCs. Samples were heated with 20 fluorescence scans/degree in a Lightcycler (Roche) instrument. For DSC, thermal unfolding was monitored by measuring heat capacity as temperature was increased at a rate of 1 degree Celsius per min in a MicroCal VP-DSC instrument. Melting temperatures were calculated using in the respective controller software packages assuming a 3-state model.

Figure 15:
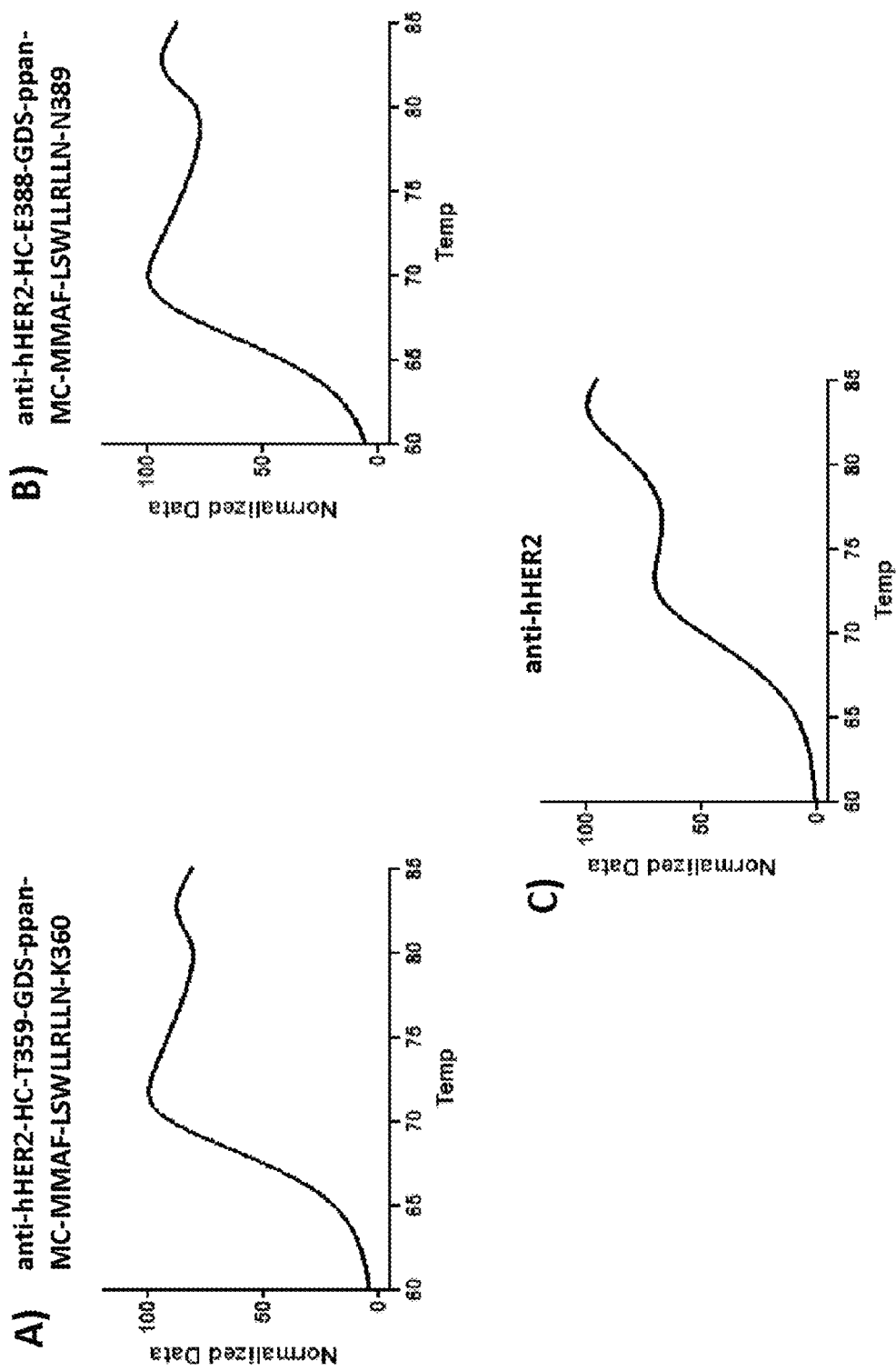
FIG. 15. Thermal stability of peptide-tagged ADCs as measured by differential scanning fluorometry (DSF) using SYPRO Orange gel stain. (A) Determination of the thermal stability of the immunoconjugate anti-hHER2-HC-T359-GDS-ppan-MC-MMAF-LSWLLRLLN-K360 (SEQ ID NO: 1117). Two transition temperatures of 68.5 and 81.5 degrees Celsius are observed by DSF (average of two measurements). (B) Determination of the thermal stability of the immunoconjugate anti-hHER2-HC-E388-GDS-ppan-MC-MMAF-LSWLLRLLN-N389 (SEQ ID NO: 1118). Two transition temperatures of 66.3 and 81.0 degrees Celsius are observed by DSF (single measurement). (C) Determination of the thermal stability of unmodified Trastuzumab IgG1 (anti-hHER2) which was used as reference for comparison with peptide-tagged ADCs. Two transition temperatures of 69.7 and 81.1 degrees Celsius are observed by DSF (average of two measurements).

As described previously (Wakankar et al. Bioconjugate Chem. 2010, 21, 1588-1595), unmodified trastuzumab exhibits two transitions. The transitions were observed at 69.7 and 81.1 degrees Celsius by DSF and 72.3 and 81.0 degrees Celsius by DSC. Similar to the unmodified antibody, most CoA-MC-MMAF immunoconjugates exhibit two transitions although with different amplitudes (FIG. 15). DSF and DSC measurements of thermal melting points agree well although DSF reports a roughly 2 degree lower first transition. Generally, most engineered, non-conjugated antibodies and the respective peptide-tagged ADCs show little destabilization as compared to the wild-type antibody anti-hHER2.

TABLE 17

Thermal stability as measured by DSF. ΔTm values are relative to unmodified anti-hHER2 antibody.

| SEQ ID NO | Sample (whole antibody tested, the name represents part of the HC or LC that contains the peptide tag, the paired wildtype chain is not listed) | Tm$_1$/° C. | Tm$_2$/° C. | ΔTm$_1$/° C. | ΔTm$_2$/° C. |
|---|---|---|---|---|---|
| 93/25 | anti-hHER2 | 69.7 | 81.2 | | |
| 94 | anti-hHER2-HC-V2-GDSLSWLLRLLN-Q3 | 70.8 | — | 1.1 | — |
| 95 | anti-hHER2-HC-V2-DSLEFIASKLA-Q3 | 70.0 | 78.0 | 0.3 | −3.1 |
| 102 | anti-hHER2-HC-S132D-K133S-S134L-T135E-S136F-G137I-G138A-T139S-A140K-A141L-L142A | 69.3 | — | −0.4 | — |
| 103 | anti-hHER2-HC-K133G-S134D-T135S-S136L-G137S-G138W-LLRLLN-T139 | 68.4 | 81.0 | −1.3 | −0.1 |
| 109 | anti-hHER2-HC-P189G-S190D-S191-S192L-L193S-G194W-T195L | 69.6; 69.3 | 81.0; 80.6 | −0.1; −0.4 | −0.1; −0.5 |
| 110 | anti-hHER2-HC-P189G-S190D-S191-S192L-L193S-G194W-T195L-LRLLN-Q196 | 69.4 | 80.7 | −0.3 | −0.4 |
| 112 | anti-hHER2-HC-P189D-S190-S191L-S192E-L193F-G194I-T195A-Q196S-T197K-Y198L-I199A | 69.4 | 78.6 | −0.3 | −2.5 |
| 113 | anti-hHER2-HC-S190G-S191D-S192-L193-G194S-T195W-Q196L-T197L-RLLN-Y198 | 68.1 | 78.1 | −1.7 | −3.1 |
| 114 | anti-hHER2-HC-S190D-S191-S192L-L193E-G194F-T195I-Q196A-T197S-Y198K-I199L | 67.8 | — | −1.9 | — |
| 115 | anti-hHER2-HC-S190D-S191-S192L-L193E-G194F-T195I-Q196A-T197S-Y198K-I199L-C200A | 67.1 | — | −2.6 | — |
| 116 | anti-hHER2-HC-S191D-S192-L193-G194E-T195F-Q196I-T197A-Y198S-I199K | 69.3 | — | −0.4 | — |
| 121 | anti-hHER2-HC-T359-GDSLSWLLRLLN-K360 | 70.1; 70.3 | 81.7; 81.7 | 0.3; 0.5 | 0.6; 0.6 |
| 1117 | anti-hHER2-HC-T359-GDS-ppan-MC-MMAF-LSWLLRLLN-K360 | 68.4; 68.6 | 81.5; 81.4 | −1.3; −1.2 | 0.4; 0.3 |
| 122 | anti-hHER2-HC-T359-DSLEFIASKLA-K360 | 70.1 | 81.7 | 0.3 | 0.6 |
| 127 | anti-hHER2-HC-E388-GDSLSWLLRLLN-N389 | 66.6 | 81.5 | −3.1 | 0.4 |
| 1118 | anti-hHER2-HC-E388-GDS-ppan-MC-MMAF-LSWLLRLLN-N389 | 66.3 | 81.0 | −3.4 | −0.1 |
| 1107 | anti-hHER2-HC-E388-GDS-ppan-MC-ValCit-PABC-MMAF-LSWLLRLLN-N389 | 66.7 | 80.9 | −3.0 | −0.2 |
| 131 | anti-hHER2-HC-E388-DSLEFIASK-N389 | 69.4 | 81.6 | −0.3 | 0.5 |
| 130 | anti-hHER2-HC-E388-DSLEFIASKL-N389 | 68.9 | 81.5 | −0.9 | 0.4 |
| 129 | anti-hHER2-HC-E388-DSLEFIASKLA-N389 | 69.3 | 81.6 | −0.4 | 0.5 |
| 135 | anti-hHER2-HC-L398D-D399S-S400L-D401E-G402F-S403I-F404A-F405S-L406K-Y407L-S408A | 49.2 | 81.2 | −20.6 | 0.1 |
| 141 | anti-hHER2-HC-K447-DSLEFIASKLA | 70.1 | 81.0 | 0.4 | −0.1 |
| 27 | anti-hHER2-LC-I2-DSLEFIASKLA-Q3 | 70.0 | 78.8 | 0.2 | −2.3 |
| 29 | anti-hHER2-LC-C214-DSLEFIASKLA | 69.7 | 80.9 | 0.0 | −0.2 |

TABLE 18

Thermal stability as measured by DSC. ΔTm values are relative to unmodified anti-hHER2 antibody.

| SEQ ID No (antibody) | Sample | Tm1/° C. | Tm2/° C. | Tm3/° C. | ΔTm1/° C. | ΔTm2/° C. |
|---|---|---|---|---|---|---|
| 93/25 | anti-hHER2 | 72.3; 72.3 | 80.9; 81.0 | — | | |
| 95 | anti-hHER2-HC-V2-DSLEFIASKLA-Q3 | 72.3 | 77.9 | 83.3 | 0.1 | −3.1 |
| 1120 | anti-hHER2-HC-V2-GDS-ppan-MC-MMAF-LSWLLRLLN-Q3 | 70.4 | 82.6 | — | −1.9 | 1.7 |
| 102 | anti-hHER2-HC-S132D-K133S-S134L-T135E-S136F-G137I-G138A-T139S-A140K-A141L-L142A | 70.3 | 76.2 | 83.3 | −2.0 | −4.8 |
| 103 | anti-hHER2-HC-K133G-S134D-T135S-S136L-G137S-G138W-LLRLLN-T139 | 69.7 | 80.5 | — | −2.6 | −0.5 |
| 109 | anti-hHER2-HC-P189G-S190D-S191-S192L-L193S-G194W-T195L | 72.8; 70.7 | 80.1; 79.9 | — | 0.5; −1.6 | −0.9; −1.1 |
| 110 | anti-hHER2-HC-P189G-S190D-S191-S192L-L193S-G194W-T195L-LRLLN-Q196 | 71.2 | 80.0 | — | −1.1 | −1.0 |

TABLE 18-continued

Thermal stability as measured by DSC. ΔTm values are relative to unmodified anti-hHER2 antibody.

| SEQ ID No (antibody) | Sample | Tm1/° C. | Tm2/° C. | Tm3/° C. | ΔTm1/° C. | ΔTm2/° C. |
|---|---|---|---|---|---|---|
| 121 | anti-hHER2-HC-T359-GDSLSWLLRLLN-K360 | 70.4; 70.6 | 80.9; 80.6 | — | −1.9; −1.6 | −0.1; −0.4 |
| 1117 | anti-hHER2-HC-T359-GDS-ppan-MC-MMAF-LSWLLRLLN-K360 | 68.7 | 80.6 | — | −3.6 | −0.4 |
| 1117 | anti-hHER2-HC-T359-GDS-ppan-MC-MMAF-LSWLLRLLN-K360 | 68.8 | 80.4 | — | −3.5 | −0.6 |
| 122 | anti-hHER2-HC-T359-DSLEFIASKLA-K360 | 71.8 | 80.9 | — | −0.5 | −0.1 |
| 1118 | anti-hHER2-HC-E388-GDS-ppan-MC-MMAF-LSWLLRLLN-N389 | 67.0 | 80.2 | — | −5.3 | −0.8 |
| 1107 | anti-hHER2-HC-E388-GDS-ppan-MC-ValCit-PABC-MMAF-LSWLLRLLN-N389 | 66.0 | 80.1 | — | −6.3 | −0.9 |
| 131 | anti-hHER2-HC-E388-DSLEFIASK-N389 | 71.2 | 80.8 | — | −1.0 | −0.2 |
| 130 | anti-hHER2-HC-E388-DSLEFIASKL-N389 | 70.7 | 80.8 | — | −1.6 | −0.2 |
| 1121 | anti-hHER2-HC-E388-DS-ppan-MC-MMAF-LEFIASKL-N389 | 69.9 | 80.2 | — | −2.3 | −0.8 |
| 129 | anti-hHER2-HC-E388-DSLEFIASKLA-N389 | 71.1 | 80.8 | — | −1.2 | −0.2 |
| 1122 | anti-hHER2-HC-E388-DS-ppan-MC-MMAF-LEFIASKLA-N389 | 70.2 | 80.3 | — | −2.1 | −0.7 |
| 135 | anti-hHER2-HC-L398D-D399S-S400L-D401E-G402F-S403I-F404A-F405S-L406K-Y407L-S408A | — | 81.0 | — | — | 0.1 |
| 141 | anti-hHER2-HC-K447-DSLEFIASKLA | 72.7 | 81.0 | — | 0.4 | 0.1 |
| 29 | anti-hHER2-LC-C214-DSLEFIASKLA | 71.6 | 81.1 | — | −0.7 | 0.1 |

Example 17

Pharmacokinetic Properties of Peptide-Tagged ADCs

Figure 16:
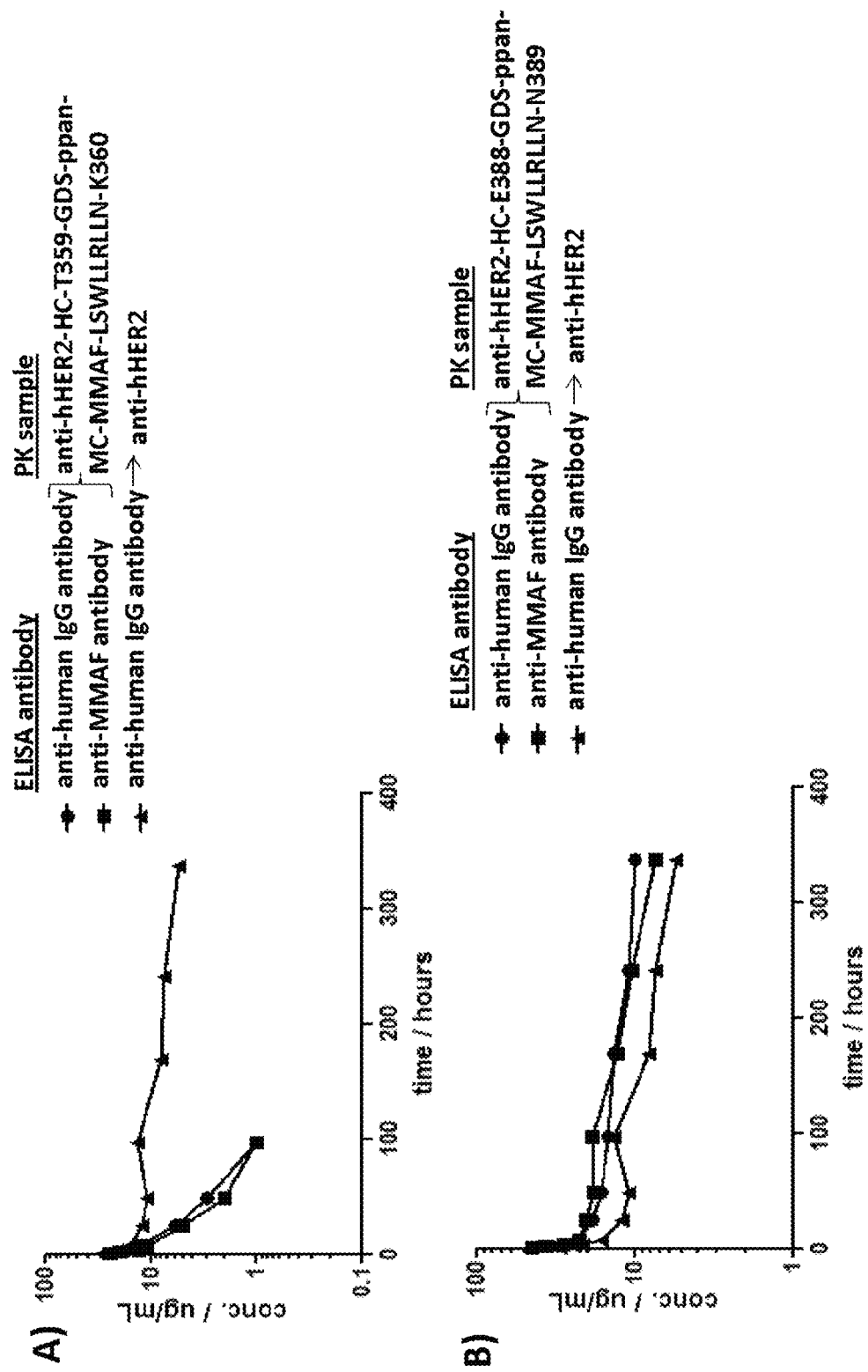
FIG. 16. Pharmacokinetic (PK) study of two peptide-tagged Trastuzumab immunoconjugates. Plasma titers of both ADCs were determined by capturing the respective immunoconjugates with plate-absorbed human HER2 (extracellular domains 3-4) followed by detection with anti-human IgG and anti-MMAF antibodies. (A) Comparison of plasma titers of anti-hHER2-HC-T359-GDS-ppan-MC-MMAF-LSWLLRLLN-K360 (SEQ ID NO: 1117) and unmodified Trastuzumab (anti-hHER2) antibody by ELISA. The plasma titer of the immunoconjugate exhibits a rapid decay within 4 days. (B) Comparison of plasma titers of anti-hHER2-HC-E388-GDS-ppan-MC-MMAF-LSWLL-RLLN-N389 (SEQ ID NO: 1118) and unmodified Trastuzumab (anti-hHER2) antibody by ELISA. The plasma titer of the immunoconjugate closely parallels the control titer of the unmodified anti-hHER2 antibody within a 14 day period.

To check the in vivo stability of two peptide-tagged Trastuzumab ADCs with MMAF payload (DAR of 2), we conducted a pharmacokinetic (PK) study in mice. Anti-hHER2-HC-T359-GDS-ppan-MC-MMAF-LSWLLRLLN-K360 (SEQ ID NO: 1117) and anti-hHER2-HC-E388-GDS-ppan-MC-MMAF-LSWLLRLLN-N389 (SEQ ID NO: 1118) were injected i.v. into 3 mice using ADC concentrations of 1.0 mg/kg. 10 samples were collected at 0.2, 1, 3, 7, 24, 48, 96, 168, 240, and 336 hours. The plasma titers of both ADCs were monitored up to two weeks using ELISA assays with anti-human IgG as well as anti-MMAF antibodies and ELISA plates coated with truncated human HER2 (extracellular domains 3-4). The ELISA results were then compared to PK studies of an unmodified Trastuzumab IgG1. While anti-hHER2-HC-T359-GDS-ppan-MC-MMAF-LSWLLRLLN-K360 (SEQ ID NO: 1117) showed a fast decay in mice in comparison to unmodified trastuzumab, anti-hHER2-HC-E388-GDS-ppan-MC-MMAF-LSWLLRLLN-N389 (SEQ ID NO: 1118) exhibited a serum clearance similar to unmodified trastuzumab over a two week time period (FIG. 16). For both ADCs, anti-hIgG and anti-MMAF titers track each other, suggesting that little if any drug is lost during the in vivo exposure in mice.

Example 18

In Vitro Potency of Peptide-Tagged ADCs

Figure 17:
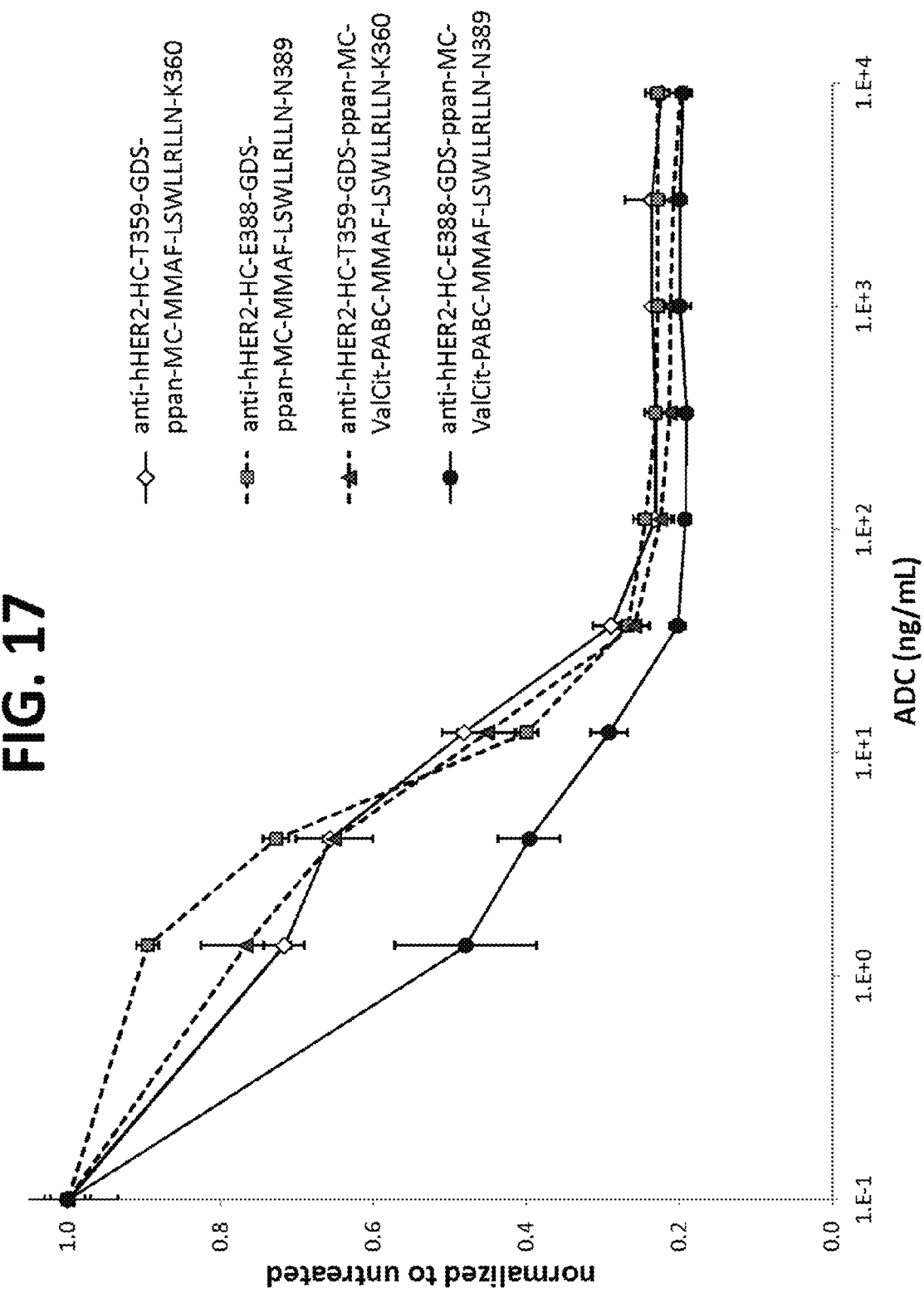
FIG. 17. In vitro cell-killing assay of peptide-tagged immunoconjugates using the HER2-expressing MDA-231 cell line. Plots are based on cell viability measurements using the Cell Titer Glo Luminescent Cell Viability Assay (Promega). Figure discloses 'anti-hHER2-HC-T359-GDS-ppan-MC-MMAF-LSWLLRLLN-K360,' 'anti-hHER2-HC-E388-GDS-ppan-MC-MMAF-LSWLLRLLN-N389,' 'anti-hHER2-HC-T359-GDS-ppan-MC-ValCit-PABC-MMAF-LSWLLRLLN-K360,' and 'anti-hHER2-HC-E388-GDS-ppan-MC-ValCit-PABC-MMAF-LSWLLRLLN-N389' as SEQ ID NOS 1117, 1118, 1108, and 1107, respectively.

In vitro cell-killing assays of peptide-tagged ADCs were carried out with the HER2-expressing MDA-231 cell line. ADCs with DAR=2 were prepared as described in Example 6 by reacting anti-hHER2-HC-T359-GDSLSWLLRLLN-K360 (SEQ ID NO:121) and anti-hHER2-HC-E388-GDSLSWLLRLLN-N389 (SEQ ID NO:127) with non-cleavable MC-MMAF and cleavable MC-ValCit-PABC-MMAF (Example 12). The in vitro potency of the corresponding ADCs, anti-hHER2-HC-T359-GDS-ppan-MC-MMAF-LSWLLRLLN-K360 (SEQ ID NO: 1117), anti-hHER2-HC-E388-GDS-ppan-MC-MMAF-LSWLLRLLN-N389 (SEQ ID NO: 1118), anti-hHER2-HC-T359-GDS-ppan-MC-ValCit-PABC-MMAF-LSWLLRLLN-K360 (SEQ ID NO: 1108), and anti-hHER2-HC-E388-GDS-ppan-MC-ValCit-PABC-MMAF-LSWLLRLLN-N389 (SEQ ID NO: 1107) were tested in PC3-31 (high copy number of HER2) and PC3 (low copy number of HER2) ErbB2 engineered cells. Regarding the PC3-31 cell line, all peptide-tagged ADCs revealed potent cytotoxic activities with inhibitory concentrations ($IC_{50}$) in the picomolar or sub-picomolar range. In contrast, the corresponding $IC_{50}$ values on PC3 cells were equal or higher than 23 nM. The results are summarized in Table 19 and FIG. 17 and indicate that all four conjugates are highly potent ADCs and kill HER2/neu-positive cells in an antigen-dependent manner.

TABLE 19

In vitro potency of S6-tag conjugated MMAF immunoconjugates.

| SEQ ID NO: | ADC | IC$_{50}$ value | |
|---|---|---|---|
| | | PC3-31 cell line | PC3 cell line |
| 1117 | anti-hHER2-HC-T359-GDS-ppan-MC-MMAF-LSWLLRLLN-K360 | 1.9 ng/mL; 13 pM | >9000 ng/mL; >60000 pM |
| 1118 | anti-hHER2-HC-E388-GDS-ppan-MC-MMAF-LSWLLRLLN-N389 | 5.8 ng/mL; 39 pM | >9000 ng/mL; >60000 pM |
| 1108 | anti-hHER2-HC-T359-GDS-ppan-MC-ValCit-PABC-MMAF-LSWLLRLLN-K360 | 3.2 ng/mL; 21 pM | 3400 ng/mL; 23000 pM |
| 1107 | anti-hHER2-HC-E388-GDS-ppan-MC-ValCit-PABC-MMAF-LSWLLRLLN-N389 | 0.01 ng/mL; 0.07 pM | >9000 ng/mL; >60000 pM |

Example 19

Labeling of Peptide-Tagged IgGs with a Cytotoxic CoA Analog in Cell Culture Media The bioorthogonality of PPTase-catalyzed 4'-phosphopantetheinylation enables the site-specific labeling of peptide-tagged IgGs in complex mixtures such as conditioned medium. Following the secretion of the peptide-tagged antibody, exogenously added PPTase (such as Sfp) and drug-CoA substrate (such as CoA-MC-MMAF) lead to the formation of homogeneous ADCs, which can be purified in a single step using protein A affinity chromatography.

For example, HEK293F cells are transfected with plasmid DNA coding for IgG1 heavy chain with S6 tag insertion in the CH3 domain and plasmid DNA coding for unmodified kappa light chain. The 40 mL HEK293F suspension culture is cultured for five days at 37° C. After harvesting by centrifugation at 2000 rpm for 10 minutes, the medium supernatant is supplemented to a final concentration of 40 µM of CoA-MC-MMAF, 10 mM of MgCl$_2$, and 50 mM of HEPES (pH 7.5). The medium supernatant is then split into two 20 mL aliquots. Recombinantly produced Sfp enzyme (5 µM) is added to one of the aliquots (see Table 20, Experiment #2) and the enzymatic reaction is allowed to proceed for 24 hours at room temperature.

TABLE 20

In-medium labeling scheme.

| | Experiment # | |
|---|---|---|
| | 1 | 2 |
| Addition of CoA-MC-MMAF (40 µM) to medium supernatant | X | X |
| Addition of Sfp (5 µM) to medium supernatant | | X |

Antibody purification is carried out using Protein A Sepharose Fast Flow columns with 0.25 mL bed volume for each experiment. After equilibration with PBS, the medium supernatants are applied to the columns at a flow rate of about 1 mL/min and the flowthrough is collected. Following washing with 20 column volumes of PBS, bound antibody is eluted using 6 column volumes of 0.1 M sodium acetate (pH 3.0) followed by immediate neutralization with 1 M Tris/HCl (pH 10) to reach a final pH of about 8. The purity of the eluates is assessed by SDS-PAGE analysis and the antibody yield is determined by the Bradford method. Finally, Sfp-dependent in-medium ADC formation is confirmed by ESI-MS and HPLC analysis of the protein A eluates.

Example 20

In Vitro Labeling of Peptide-Tagged IgGs with Acetyl-CoA and Subsequent Conjugation with a Cytotoxin The principle of the preparation of immune conjugates via acetyl-CoA is a three-step chemoenzymatic conjugation protocol in which the acetyl moiety serves as a protecting group for the reactive thiol group of CoA. Furthermore, although PPTases such as Sfp tolerate large CoA analogs (e.g. peptidyl-CoA) for catalysis, the catalytic efficiency ($k_{cat}/K_M$) is significantly reduced compared to CoA itself (see, Sieber et al., J. Am. Chem. Soc. 125: 10862-10866 (2003)). Hence, it is expected that the small acetyl group ensures similar enzyme kinetics as seen for the native CoA substrate.

For example, covalent conjugation of the acetylated ppan moiety to a peptide-tagged IgG antibody is carried out as described in Example 6 using acetyl-CoA instead of CoA-MC-MMAF. After confirming quantitative conjugation by ESI-MS, the conjugate is dialyzed into Reaction Buffer (0.1 M sodium phosphate (pH 7.2), 0.15 M NaCl). The dialyzed conjugate is concentrated to about 5 mg/mL and supplemented with 10% (v/v) of Deacetylation Solution containing Reaction Buffer (pH 7.2) with 0.5 M hydroxylamine and 25 mM EDTA. This chemical thioester cleavage reaction is allowed to proceed for 3 hours at room temperature, followed by buffer-exchanging the reaction mixture into Reaction Buffer (pH 7.2) supplemented with 10 mM EDTA. After confirmation of quantitative deacetylation by ESI-MS, the deprotected ppan moiety is then conjugated with 15 equivalents of thiol-reactive maleimide-MC-MMAF (0.5 mM) for 1 hour at room temperature. The reaction is quenched by buffer-exchange into PBS. Finally, quantitative ADC formation is confirmed by ESI-MS and HPLC analysis.

Example 21

Labeling of Peptide-Tagged IgGs with Acetyl-CoA in Cell Culture Media and Subsequent Conjugation with a Cytotoxin The bioorthogonality of PPTase-catalyzed generation of homogeneous ADCs allows the site-specific labeling of IgGs in cell culture media (see Example 19). Instead of directly attaching the cytotoxic drug molecule to the antibody, it is also possible to carry out in-medium labeling with acetyl-CoA for ADC generation via a three-step chemoenzymatic conjugation process. The small acetyl-CoA analog allows conjugation reactions with improved catalytic efficiency ($k_{cat}/K_M$) as compared to large cytotoxic CoA analogs, thereby significantly decreasing the amount of enzyme needed for quantitative conjugation. Furthermore, for process development, it would be advantageous to perform labeling reactions in large culture volumes with non-toxic compounds. The peptide-tagged IgG conjugated with the acetyl-ppan moiety can be purified in a single step using protein A affinity chromatography. In order to prepare the immune conjugate starting from the purified acetyl-ppan-conjugated antibody, the two subsequent chemical reactions are carried out as described in Example 20.

Example 22

Labeling of Peptide-Tagged IgGs with Acetyl-CoA or Bioorthogonal CoA Analogs in Cell Culture Media and Subsequent Conjugation with a Cytotoxin The bioorthogonality of PPTase-catalyzed generation of homogeneous ADCs also allows the site-specific labeling of IgGs in cell culture media (see Example 19). Instead of directly attaching the cytotoxic drug molecule to the antibody, it is also possible to carry out in-medium labeling with acetyl-CoA for ADC generation via a three-step chemoenzymatic conjugation process. The small acetyl-CoA analog allows conjugation reactions with improved catalytic efficiency ($k_{cat}/K_M$) as compared to large cytotoxic CoA analogs, thereby significantly decreasing the amount of enzyme needed for quantitative conjugation. Furthermore, for process development, it would be advantageous to perform labeling reactions in large culture volumes with non-toxic compounds. The peptide-tagged IgG conjugated with the acetyl-ppan moiety can be purified in a single step using protein A affinity chromatography. In order to prepare the immune conjugate starting from the purified acetyl-ppan-conjugated antibody, the two subsequent chemical reactions are carried out as described in Example 20.

Alternatively, instead of using acetyl-CoA, in-medium labeling can also be performed with CoA analogs covalently linked to bioorthogonal groups, such as azido, alkene, ketone, or aldehyde moieties. Following in-medium PPTase catalysis, the peptide-tagged antibody with the ppan-bound bioorthogonal group is purified to homogeneity using protein A affinity chromatography. As the last step of this two-step chemoenzymatic labeling strategy for ADC preparation, the reaction with the complementary bioorthogonal group leads to the site-specific attachment of the drug moiety to the antibody.

Example 23

Production and Properties of ADCs with a DAR of 4

Figure 18:
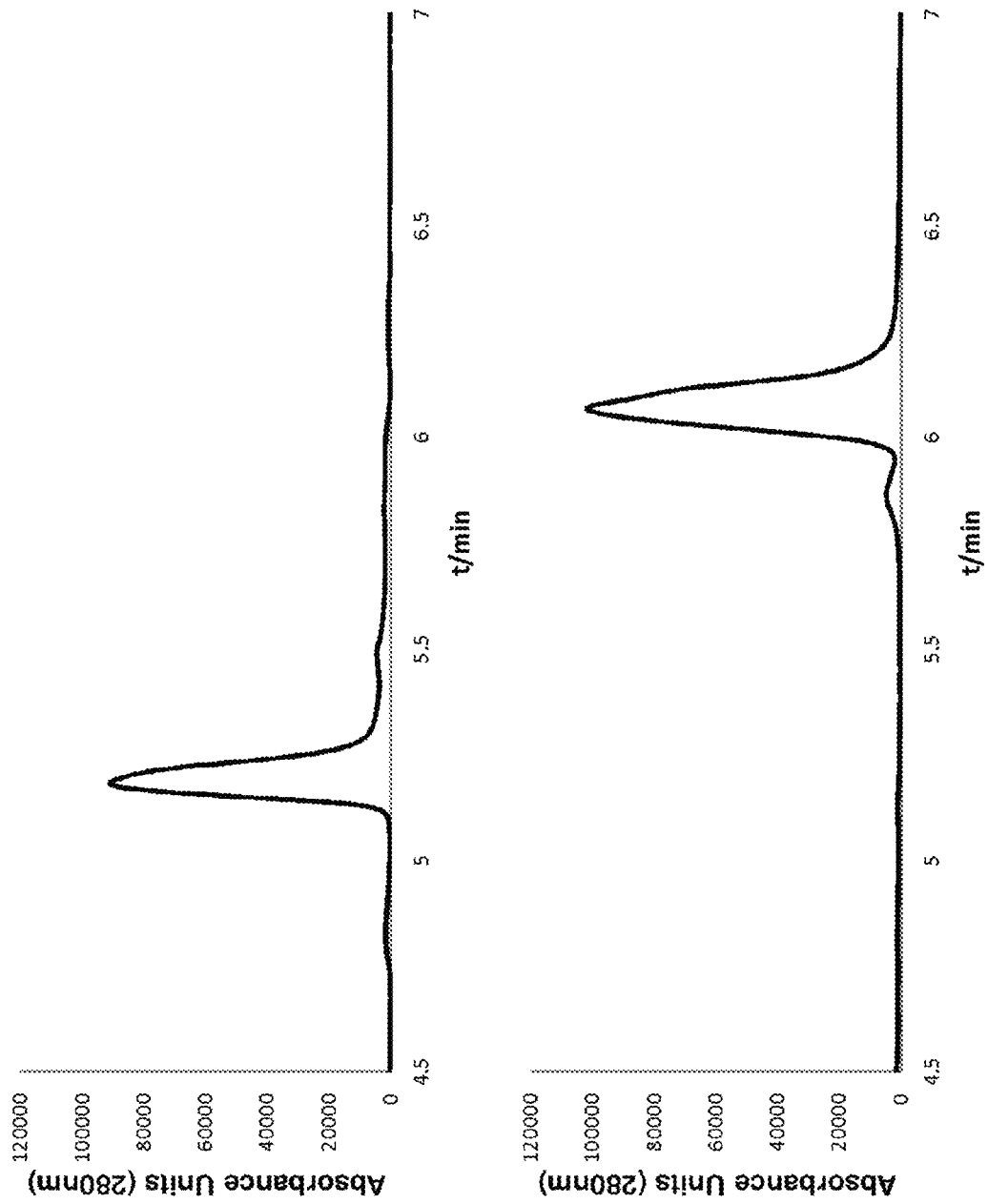
FIG. 18. Enzymatic generation of ADCs with a DAR of 4. (A) ADCs with a DAR of 4 can be generated by incorporating multiple peptide tags into an antibody, such as the ybbR- and the S6-tags. (B) HPLC analysis of Sfp-catalyzed conjugation of CoA-MC-MMAF to Trastuzumab IgG containing an S6 tag in the $V_H$ domain as well as a ybbR tag in the CH3 domain (anti-hHER2-HC-V2-GDSLSWLL-RLLN-Q3-E388-DSLEFIASKLA-N389 (SEQ ID NO: 142)). Room temperature incubation of 2.5 µM of antibody and 50 µM of CoA substrate in the presence of 1 µM of Sfp enzyme leads to near quantitative formation of an ADC with a DAR of 4 ($t_R$=6.1 min, bottom trace). The top trace represents the corresponding uncoupled antibody (DAR=0, $t_R$=5.2 min).

ADCs with a DAR of 4 can be generated by inserting/grafting multiple peptide tags into an antibody, which are substrates of the same enzyme (FIG. 18A). For instance, both the ybbR- and the S6-tags are recognized as substrates by the PPTase Sfp. Conversely, labeling of antibodies with multiple different ligands is achieved by inserting/grafting peptide tags into an antibody, which are substrates of two different PPTases. For example, the A1 tag is exclusively recognized by the AcpS PPTase, while the S6 tag is preferentially modified by the Sfp PPTase. Furthermore, immunoconjugates with higher DARs (e.g., DARs of 6, 8, 10, 12, etc.) may be generated by adding additional tags. Enzymatic conjugation can also be combined with other labeling strategies such as site-specific conjugation through cysteine, pyrrolysine, pyrroline-carboxy-lysine, and unnatural amino acids as well as chemoselective methods such as Lys, Cys or Tyr selective chemistries.

In order to prepare homogeneous ADCs with a DAR of 4, two peptide tags were incorporated into the heavy chain of Trastuzumab IgG1, namely an S6 tag into the $V_H$ domain and a ybbR tag into the CH3 domain (anti-hHER2-HC-V2-GDSLSWLLRLLN-Q3-E388-DSLEFIASKLA-N389 (SEQ ID NO: 142)). This dual-tagged antibody was expressed in HEK293F cells on a 50 mL scale. Following transfection, the HEK293F cells were cultured for five days before harvest by centrifugation at 3400 rpm for 15 min. The resulting medium supernatant was filtered through a 0.22-μm-pore-size filter. Purification was accomplished using a Protein A Sepharose Fast Flow column (GE Healthcare) with a bed volume of 0.6 mL, which was equilibrated with 20 column volumes of PBS. The filtered medium supernatant was loaded at a flow rate of about 1 mL/min. After washing the column with 20 column volumes of PBS, the peptide-tagged antibody was eluted with 5 column volumes of 0.1 M sodium acetate (pH 3.0) followed by immediate neutralization with 1 M Tris/HCl (pH 10) to a final pH of about 8. According to the Bradford method, the total yield was 8 mg of purified antibody per liter culture. The purity of the antibody construct was assessed by SDS-gel electrophoresis. After concentration with a 30 kDa cut-off Amicon Ultra Centrifugal Filter Unit, 2.5 μM anti-hHER2-HC-V2-GDSLSWLLRLLN-Q3-E388-DSLEFIASKLA-N389 (SEQ ID NO: 142) was incubated with 50 μM CoA-MC-MMAF, 1 μM Sfp, 12.5 mM $MgCl_2$, in 75 mM HEPES buffer, pH 7.5, at 23° C. for 16 hours to enzymatically label the dual-tagged antibody with four drug molecules.

The deconvoluted mass spectrum of the reduced and deglycosylated antibody construct confirmed the covalent attachment of two ppan-MC-MMAF units to each heavy chain of Trastuzumab (observed mass, 54223.20 Da; expected mass, 54231 Da). Neither uncoupled (expected mass, 51700 Da) nor mono-labeled species (expected mass, 52966 Da) were observed by ESI-MS. Near quantitative conversion to an ADC with a DAR of 4 (95% according to peak area integration) was further confirmed by HPLC analysis (FIG. 18B).

Example 24

Generation of a Comprehensive Library of Peptide-Tagged ADCs Using the Protein Expression and Purification Platform (PEPP)

Based on the examination of the crystal structure of human IgG1 B12 antibody as well as surface accessibility calculations (Example 1), a library of 268 peptide-tagged trastuzumab IgG1 constructs was proposed. Systematic insertion of S6 and ybbR tag sequences into the constant regions was accomplished by standard molecular biology methods using the oligonucleotides listed in Table 8. Sequence confirmed plasmids harboring either the heavy or light chain genes of trastuzumab were used for transient co-transfection of 293 Freestyle™ cells according to the PEI method (Meissner et al., 2001). Culturing of each library member in a volume of 35 mL of Freestyle™ expression media (Invitrogen) for five days at 37° C. under 5% $CO_2$ was carried out on the PEPP system (Gonzalez R, Jennings L L, Knuth M, Orth A P, Klock H E, Ou W, Feuerhelm J, Hull M V, Koesema E, Wang Y, Zhang J, Wu C, Cho C Y, Su A I, Batalov S, Chen H, Johnson K, Laffitte B, Nguyen D G, Snyder E Y, Schultz P G, Harris J L, Lesley S A. Proc Natl Acad Sci USA. 2010, 107(8):3552-7). Following automated cell harvest, the same system was used to purify the library of peptide-tagged antibodies by Protein A affinity chromatography. Briefly, after 0.22 μm filtration of the medium supernatant, each filtrate was loaded onto a Protein A affinity column containing 0.2 mL of settled resin at an approximate flow rate of 1 mL/min. The column was then washed with 20 column volumes of PBS followed by elution with 5 column volumes of 0.1 M sodium acetate, pH 3.0. The eluate was immediately neutralized with 25% (v/v) of 1 M Tris-HCl (pH 8.0).

To determine the yield of the Protein A-purified antibodies (Table 21), protein concentrations of the eluates were measured in duplicate on a ND-1000 UV-Vis spectrophotometer (NanoDrop Technologies) at 280 nm using the preset molar extinction coefficient for IgG molecules. After concentrating the peptide-tagged antibodies using 30 kDa cut-off Amicon Ultra-0.5 centrifugal filter devices (EMD Millipore), enzyme-catalyzed conjugation reactions were performed for about 16 hours at 20° C. with 2.5 μM of peptide-tagged antibody, 20 μM of CoA-MC-MMAF substrate, and 1 μM of Sfp enzyme in Tris-HCl buffer (75 mM, pH 8.0) supplemented with 12.5 mM of $MgCl_2$ and 20 mM of NaCl. The degree of labeling of the peptide-tagged antibodies was quantified by analytical HPLC on a PLRP-S column (4000 Å, 5 μM, 50×4.6 mm, Agilent Technologies) with a 6-min linear gradient of 25-50% acetonitrile in water containing 0.1% trifluoroacetic acid. The corresponding uncoupled antibodies were used as negative controls (Table 21). After concentrating the antibody conjugates using Amicon Ultra-4 centrifugal filter devices (EMD Millipore), the enzymatic reactions were further analyzed by mass spectrometry on an Agilent 6520 Q-TOF instrument (Agilent Technologies). Deconvoluted ESI-MS spectra of the reduced and deglycosylated antibody conjugates were obtained by using 10 μL of concentrated reaction mixture (Table 21).

The peptide-tagged ADC constructs were further purified by Ni-NTA (nickel-nitrilotriacetic acid) chromatography to remove Sfp enzyme and excess CoA-MC-MMAF substrate. After equilibration of the Ni-NTA columns (0.2 mL bed volume each) with PBS, the concentrated conjugation samples were loaded onto the columns at an approximate flow rate of 1 mL/min. Next, the columns were washed with 20 column volumes of PBS followed by elution with 5 column volumes of Tris-HCl buffer (50 mM, pH 8.0) supplemented with 250 mM imidazole and 300 mM NaCl. According to Bradford assay, the recovery of the peptide-tagged ADCs averaged 39% of the Protein A-purified starting material. The PEPP system was then used to buffer-exchange each sample into PBS using NAP-10 Columns (GE Healthcare). Following buffer-exchange, the peptide-tagged ADCs were concentrated using Amicon Ultra-4 centrifugal filter devices (EMD Millipore), and the concentrations of the conjugates were adjusted by dilution with PBS. Adjusted to the appropriate concentration, the ADC samples were further characterized by DSF (differential scanning fluorimetry), LC90 (LabChip 90), AnSEC (analytical size-exclusion chromatography), and in vitro potency assays (data not shown).

Of the originally planned 268 peptide-tagged trastuzumab antibodies, expression was tested for 183 constructs (68%). The expression levels exhibit a great variability ranging from 0 to more than 30 mg of antibody per liter culture (Table 21), with the average being 16 mg (±8 mg standard deviation) of antibody per liter culture. Furthermore, the expression levels correlate with the position of the peptide tag insertion with the 46 light chain constructs (13±8 mg per liter culture) exhibiting lower average expressions levels than the 137 heavy chain constructs (17±8 mg per liter culture). The expression levels also depend on the type of peptide tag: 95 antibody constructs with ybbR tag insertions on average show higher expression levels (19±7 mg per liter culture) than the corresponding 88 constructs with S6 tag insertions (13±8 mg per liter culture). The opposite trend is observed for the conjugation efficiencies based on reverse-phase HPLC analysis: 44 (72%) peptide-tagged constructs with near quantitative ADC formation (drug-to-antibody ratio≥1.9) are based on insertion of the S6 peptide sequence, while only 17 (28%) ybbR-tagged antibodies displayed near quantitative conversion to the corresponding ADC.

On average, heavy chain constructs were conjugated more efficiently than peptide insertions in the light chain: 19% (8 out of 43) of the constructs with peptide tag insertions in the light chain revealed DARs of at least 1.9 while 40% (53 out of 131) of the constructs with peptide tag insertions in the heavy chain could be conjugated with the same efficiency. The best overall conjugation efficiencies are displayed by peptide tag insertions in several loop regions of the CH1 domain. Overall, of the 183 expressed peptide-tagged antibodies, conjugation efficiencies of 174 constructs could be determined with 61 (35%) constructs yielding drug-to-antibody ratios (DARs) of 1.9 or higher.

Thermostability of the resulting ADCs depends on the site of peptide tag insertion. For instance, most peptide tag insertions in the CH2 domain lead to a significant decrease of the lowest observed thermal transition (Tm1) according to DSF (differential scanning fluorimetry) measurements as will be illustrated in more detail in Example 25. Little aggregation or antibody oligomers were observed for 135 (87%) out of 156 peptide-tagged ADCs that were examined by analytical size-exclusion chromatography (≥90% monomeric species). The in vitro potency of the peptide-tagged ADCs correlated as expected with their degree of labeling. Although a large number of peptide-tagged ADCs with preferred properties can be generated, the data also illustrate that expression yield, thermal stability, conjugation efficiency and other properties are greatly affected by the choice of tag insertion site.

TABLE 21

ADC preparation and characterization of material prepared on PEPP system.

| Antibody SEQ ID | ADC name[a] | ADC SEQ ID NO | Antibody yield[b] (mg/L) | DAR[c] | Expected mass antibody[d] (Da) | Expected mass ADC[e] (Da) | Observed mass[f] (Da) |
|---|---|---|---|---|---|---|---|
| SEQ ID NO: 150 | anti-hHER2-HC-A118-GDS-ppan-MC-MMAF-LSWLLRLLN-S119 | SEQ ID NO: 1136 | 10 | 2.0 | 50525.0 | 51790.5 | 51792.7 51814.6 |

TABLE 21-continued

ADC preparation and characterization of material prepared on PEPP system.

| Antibody SEQ ID | ADC name[a] | ADC SEQ ID NO | Antibody yield[b] (mg/L) | DAR[c] | Expected mass antibody[d] (Da) | Expected mass ADC[e] (Da) | Observed mass[f] (Da) |
|---|---|---|---|---|---|---|---|
| SEQ ID NO: 151 | anti-hHER2-HC-S119-GDS-ppan-MC-MMAF-LSWLLRLLN-T120 | SEQ ID NO: 1137 | 12 | 2.0 | 50525.0 | 51790.5 | 51792.4 |
| SEQ ID NO: 152 | anti-hHER2-HC-T120-GDS-ppan-MC-MMAF-LSWLLRLLN-K121 | SEQ ID NO: 1138 | 11 | 2.0 | 50525.0 | 51790.5 | 51797.2 |
| SEQ ID NO: 157 | anti-hHER2-HC-T135-GDS-ppan-MC-MMAF-LSWLLRLLN-S136 | SEQ ID NO: 1139 | 24 | 2.0 | 50525.0 | 51790.5 | 51792.8 |
| SEQ ID NO: 158 | anti-hHER2-HC-S136-GDS-ppan-MC-MMAF-LSWLLRLLN-G137 | SEQ ID NO: 1140 | 20 | 2.0 | 50525.0 | 51790.5 | 51792.0 |
| SEQ ID NO: 160 | anti-hHER2-HC-G138-GDS-ppan-MC-MMAF-LSWLLRLLN-T139 | SEQ ID NO: 1141 | 14 | 2.0 | 50525.0 | 51790.5 | 51792.3 51814.6 |
| SEQ ID NO: 161 | anti-hHER2-HC-E152-GDS-ppan-MC-MMAF-LSWLLRLLN-P153 | SEQ ID NO: 1142 | 3 | 0.2 | 50525.0 | 51790.5 | 50528.4 51794.8 |
| SEQ ID NO: 162 | anti-hHER2-HC-P153-GDS-ppan-MC-MMAF-LSWLLRLLN-V154 | SEQ ID NO: 1143 | 0 | N/A | 50525.0 | 51790.5 | N/A |
| SEQ ID NO: 163 | anti-hHER2-HC-N159-GDS-ppan-MC-MMAF-LSWLLRLLN-S160 | SEQ ID NO: 1144 | 0 | N/A | 50525.0 | 51790.5 | N/A |
| SEQ ID NO: 164 | anti-hHER2-HC-S160-GDS-ppan-MC-MMAF-LSWLLRLLN-G161 | SEQ ID NO: 1145 | 10 | 1.4 | 50525.0 | 51790.5 | 51792.0 |
| SEQ ID NO: 165 | anti-hHER2-HC-G161-GDS-ppan-MC-MMAF-LSWLLRLLN-A162 | SEQ ID NO: 1146 | 9 | 1.3 | 50525.0 | 51790.5 | 51798.0 50529.2 |
| SEQ ID NO: 166 | anti-hHER2-HC-A162-GDS-ppan-MC-MMAF-LSWLLRLLN-L163 | SEQ ID NO: 1147 | 15 | 2.0 | 50525.0 | 51790.5 | 51798.4 |
| SEQ ID NO: 168 | anti-hHER2-HC-T164-GDS-ppan-MC-MMAF-LSWLLRLLN-S165 | SEQ ID NO: 1148 | 22 | 2.0 | 50525.0 | 51790.5 | 51796.8 |
| SEQ ID NO: 169 | anti-hHER2-HC-S165-GDS-ppan-MC-MMAF-LSWLLRLLN-G166 | SEQ ID NO: 1149 | 15 | 2.0 | 50525.0 | 51790.5 | 51794.4 |
| SEQ ID NO: 170 | anti-hHER2-HC-P171-GDS-ppan-MC-MMAF-LSWLLRLLN-A172 | SEQ ID NO: 1150 | 3 | N/A | 50525.0 | 51790.5 | N/A |
| SEQ ID NO: 171 | anti-hHER2-HC-S176-GDS-ppan-MC-MMAF-LSWLLRLLN-S177 | SEQ ID NO: 1151 | 8 | 1.9 | 50525.0 | 51790.5 | 51791.7 51812.9 |
| SEQ ID NO: 173 | anti-hHER2-HC-P189-GDS-ppan-MC-MMAF-LSWLLRLLN-S190 | SEQ ID NO: 1152 | 24 | 1.5 | 50525.0 | 51790.5 | 51792.4 |
| SEQ ID NO: 175 | anti-hHER2-HC-S191-GDS-ppan-MC-MMAF-LSWLLRLLN-S192 | SEQ ID NO: 1153 | 21 | 2.0 | 50525.0 | 51790.5 | 51792.0 51814.0 |
| SEQ ID NO: 176 | anti-hHER2-HC-S192-GDS-ppan-MC-MMAF-LSWLLRLLN-L193 | SEQ ID NO: 1154 | 32 | 2.0 | 50525.0 | 51790.5 | 51792.0 51813.7 |
| SEQ ID NO: 177 | anti-hHER2-HC-L193-GDS-ppan-MC-MMAF-LSWLLRLLN-G194 | SEQ ID NO: 1155 | 18 | 2.0 | 50525.0 | 51790.5 | 51791.0 |
| SEQ ID NO: 178 | anti-hHER2-HC-G194-GDS-ppan-MC-MMAF-LSWLLRLLN-T195 | SEQ ID NO: 1156 | 19 | 2.0 | 50525.0 | 51790.5 | 51796.8 |
| SEQ ID NO: 179 | anti-hHER2-HC-T195-GDS-ppan-MC-MMAF-LSWLLRLLN-Q196 | SEQ ID NO: 1157 | 17 | 2.0 | 50525.0 | 51790.5 | 51800.0 53918.8 |
| SEQ ID NO: 180 | anti-hHER2-HC-Q196-GDS-ppan-MC-MMAF-LSWLLRLLN-T197 | SEQ ID NO: 1158 | 23 | 1.9 | 50525.0 | 51790.5 | 51791.9 51813.5 |
| SEQ ID NO: 181 | anti-hHER2-HC-K205-GDS-ppan-MC-MMAF-LSWLLRLLN-P206 | SEQ ID NO: 1159 | 22 | 0.2 | 50525.0 | 51790.5 | 50526.7 51792.6 50548.6 |
| SEQ ID NO: 182 | anti-hHER2-HC-P206-GDS-ppan-MC-MMAF-LSWLLRLLN-S207 | SEQ ID NO: 1160 | 25 | 1.9 | 50525.0 | 51790.5 | 51792.1 51813.9 |

TABLE 21-continued

ADC preparation and characterization of material prepared on PEPP system.

| Antibody SEQ ID | ADC name[a] | ADC SEQ ID NO | Antibody yield[b] (mg/L) | DAR[c] | Expected mass antibody[d] (Da) | Expected mass ADC[e] (Da) | Observed mass[f] (Da) |
|---|---|---|---|---|---|---|---|
| SEQ ID NO: 185 | anti-hHER2-HC-A231-GDS-ppan-MC-MMAF-LSWLLRLLN-P232 | SEQ ID NO: 1161 | 35 | 2.0 | 50525.0 | 51790.5 | 51789.5 51810.4 |
| SEQ ID NO: 187 | anti-hHER2-HC-E233-GDS-ppan-MC-MMAF-LSWLLRLLN-L234 | SEQ ID NO: 1162 | 13 | 1.9 | 50525.0 | 51790.5 | 51789.5 51770.4 51809.6 |
| SEQ ID NO: 189 | anti-hHER2-HC-L235-GDS-ppan-MC-MMAF-LSWLLRLLN-G236 | SEQ ID NO: 1163 | 16 | 1.9 | 50525.0 | 51790.5 | 51790.1 51811.8 |
| SEQ ID NO: 191 | anti-hHER2-HC-P244-GDS-ppan-MC-MMAF-LSWLLRLLN-P245 | SEQ ID NO: 1164 | 12 | 0.8 | 50525.0 | 51790.5 | 50522.7 51790.6 50545.4 |
| SEQ ID NO: 193 | anti-hHER2-HC-I253-GDS-ppan-MC-MMAF-LSWLLRLLN-S254 | SEQ ID NO: 1165 | 23 | 1.9 | 50525.0 | 51790.5 | 51789.0 51809.6 |
| SEQ ID NO: 194 | anti-hHER2-HC-S254-GDS-ppan-MC-MMAF-LSWLLRLLN-R255 | SEQ ID NO: 1166 | 20 | 2.0 | 50525.0 | 51790.5 | 51789.5 51810.5 |
| SEQ ID NO: 195 | anti-hHER2-HC-R255-GDS-ppan-MC-MMAF-LSWLLRLLN-T256 | SEQ ID NO: 1167 | 25 | 2.0 | 50525.0 | 51790.5 | 51792.2 51814.5 |
| SEQ ID NO: 198 | anti-hHER2-HC-S267-GDS-ppan-MC-MMAF-LSWLLRLLN-H268 | SEQ ID NO: 1168 | 20 | 2.0 | 50525.0 | 51790.5 | 51789.2 51810.1 |
| SEQ ID NO: 199 | anti-hHER2-HC-H268-GDS-ppan-MC-MMAF-LSWLLRLLN-E269 | SEQ ID NO: 1169 | 10 | 2.0 | 50525.0 | 51790.5 | 51789.6 51810.0 |
| SEQ ID NO: 200 | anti-hHER2-HC-E269-GDS-ppan-MC-MMAF-LSWLLRLLN-D270 | SEQ ID NO: 1170 | 0 | N/A | 50525.0 | 51790.5 | N/A |
| SEQ ID NO: 201 | anti-hHER2-HC-D270-GDS-ppan-MC-MMAF-LSWLLRLLN-P271 | SEQ ID NO: 1171 | 18 | 2.0 | 50525.0 | 51790.5 | 51789.8 51771.0 51811.2 |
| SEQ ID NO: 202 | anti-hHER2-HC-P271-GDS-ppan-MC-MMAF-LSWLLRLLN-E272 | SEQ ID NO: 1172 | 8 | 2.0 | 50525.0 | 51790.5 | 51796.4 |
| SEQ ID NO: 206 | anti-hHER2-HC-P291-GDS-ppan-MC-MMAF-LSWLLRLLN-R292 | SEQ ID NO: 1173 | 23 | 1.8 | 50525.0 | 51790.5 | 51789.8 51811.3 |
| SEQ ID NO: 207 | anti-hHER2-HC-T307-GDS-ppan-MC-MMAF-LSWLLRLLN-V308 | SEQ ID NO: 1174 | 4 | n.d. | 50525.0 | 51790.5 | 51793.6 50526.4 |
| SEQ ID NO: 209 | anti-hHER2-HC-L309-GDS-ppan-MC-MMAF-LSWLLRLLN-H310 | SEQ ID NO: 1175 | 10 | n.d. | 50525.0 | 51790.5 | 51795.6 50530.8 |
| SEQ ID NO: 211 | anti-hHER2-HC-N315-GDS-ppan-MC-MMAF-LSWLLRLLN-G316 | SEQ ID NO: 1176 | 13 | 0.9 | 50525.0 | 51790.5 | 51788.9 50523.3 51810.4 |
| SEQ ID NO: 212 | anti-hHER2-HC-G316-GDS-ppan-MC-MMAF-LSWLLRLLN-K317 | SEQ ID NO: 1177 | 7 | 0.8 | 50525.0 | 51790.5 | 50524.1 51789.7 50545.9 |
| SEQ ID NO: 215 | anti-hHER2-HC-A327-GDS-ppan-MC-MMAF-LSWLLRLLN-L328 | SEQ ID NO: 1178 | 14 | 0.5 | 50525.0 | 51790.5 | 51789.9 50522.7 |
| SEQ ID NO: 216 | anti-hHER2-HC-L328-GDS-ppan-MC-MMAF-LSWLLRLLN-P329 | SEQ ID NO: 1179 | 16 | 1.0 | 50525.0 | 51790.5 | 51789.8 50523.2 51810.9 |
| SEQ ID NO: 217 | anti-hHER2-HC-P329-GDS-ppan-MC-MMAF-LSWLLRLLN-A330 | SEQ ID NO: 1180 | 18 | 1.5 | 50525.0 | 51790.5 | 51790.1 51811.9 |
| SEQ ID NO: 218 | anti-hHER2-HC-A330-GDS-ppan-MC-MMAF-LSWLLRLLN-P331 | SEQ ID NO: 1181 | 9 | 1.7 | 50525.0 | 51790.5 | 51792.4 50527.6 |
| SEQ ID NO: 220 | anti-hHER2-HC-K340-GDS-ppan-MC-MMAF-LSWLLRLLN-G341 | SEQ ID NO: 1182 | 6 | 1.8 | 50525.0 | 51790.5 | 51792.4 51604.8 |
| SEQ ID NO: 221 | anti-hHER2-HC-G341-GDS-ppan-MC-MMAF-LSWLLRLLN-Q342 | SEQ ID NO: 1183 | 26 | 1.9 | 50525.0 | 51790.5 | 51790.0 |
| SEQ ID NO: 222 | anti-hHER2-HC-Q342-GDS-ppan-MC-MMAF-LSWLLRLLN-P343 | SEQ ID NO: 1184 | 0 | N/A | 50525.0 | 51790.5 | N/A |

TABLE 21-continued

ADC preparation and characterization of material prepared on PEPP system.

| Antibody SEQ ID | ADC name[a] | ADC SEQ ID NO | Antibody yield[b] (mg/L) | DAR[c] | Expected mass antibody[d] (Da) | Expected mass ADC[e] (Da) | Observed mass[f] (Da) |
|---|---|---|---|---|---|---|---|
| SEQ ID NO: 223 | anti-hHER2-HC-P343-GDS-ppan-MC-MMAF-LSWLLRLLN-R344 | SEQ ID NO: 1185 | 14 | 2.0 | 50525.0 | 51790.5 | 51792.2 51809.3 |
| SEQ ID NO: 224 | anti-hHER2-HC-R344-GDS-ppan-MC-MMAF-LSWLLRLLN-E345 | SEQ ID NO: 1186 | 16 | 2.0 | 50525.0 | 51790.5 | 51794.4 |
| SEQ ID NO: 229 | anti-hHER2-HC-K360-GDS-ppan-MC-MMAF-LSWLLRLLN-N361 | SEQ ID NO: 1187 | 26 | 2.0 | 50525.0 | 51790.5 | 51796.8 |
| SEQ ID NO: 230 | anti-hHER2-HC-N384-GDS-ppan-MC-MMAF-LSWLLRLLN-G385 | SEQ ID NO: 1188 | 2 | 2.0 | 50525.0 | 51790.5 | 51792.8 |
| SEQ ID NO: 127 | anti-hHER2-HC-E388-GDS-ppan-MC-MMAF-LSWLLRLLN-N389 | SEQ ID NO: 1118 | 23 | 2.0 | 50525.0 | 51790.5 | 51794.4 |
| SEQ ID NO: 232 | anti-hHER2-HC-T394-GDS-ppan-MC-MMAF-LSWLLRLLN-P395 | SEQ ID NO: 1189 | 3 | 0.7 | 50525.0 | 51790.5 | 51793.2 50525.2 |
| SEQ ID NO: 233 | anti-hHER2-HC-P395-GDS-ppan-MC-MMAF-LSWLLRLLN-P396 | SEQ ID NO: 1190 | 4 | n.d. | 50525.0 | 51790.5 | 51794.6 51773.9 51820.4 |
| SEQ ID NO: 235 | anti-hHER2-HC-D401-GDS-ppan-MC-MMAF-LSWLLRLLN-G402 | SEQ ID NO: 1191 | 10 | 0.2 | 50525.0 | 51790.5 | 51793.7 51818.2 |
| SEQ ID NO: 236 | anti-hHER2-HC-S415-GDS-ppan-MC-MMAF-LSWLLRLLN-R416 | SEQ ID NO: 1192 | 5 | 1.1 | 50525.0 | 51790.5 | 51792.8 50526.8 |
| SEQ ID NO: 237 | anti-hHER2-HC-R416-GDS-ppan-MC-MMAF-LSWLLRLLN-W417 | SEQ ID NO: 1193 | 5 | 1.7 | 50525.0 | 51790.5 | 51794.1 |
| SEQ ID NO: 238 | anti-hHER2-HC-W417-GDS-ppan-MC-MMAF-LSWLLRLLN-Q418 | SEQ ID NO: 1194 | 15 | 1.4 | 50525.0 | 51790.5 | 51798.8 51921.6[g] |
| SEQ ID NO: 239 | anti-hHER2-HC-Q418-GDS-ppan-MC-MMAF-LSWLLRLLN-Q419 | SEQ ID NO: 1195 | 9 | 2.0 | 50525.0 | 51790.5 | 51794.4 |
| SEQ ID NO: 243 | anti-hHER2-HC-H433-GDS-ppan-MC-MMAF-LSWLLRLLN-N434 | SEQ ID NO: 1196 | 5 | 2.0 | 50525.0 | 51790.5 | 51793.6 51922.4[g] 51735.6 |
| SEQ ID NO: 244 | anti-hHER2-HC-N434-GDS-ppan-MC-MMAF-LSWLLRLLN-H435 | SEQ ID NO: 1197 | 20 | 2.0 | 50525.0 | 51790.5 | 51797.6 51923.6[g] |
| SEQ ID NO: 246 | anti-hHER2-HC-L443-GDS-ppan-MC-MMAF-LSWLLRLLN-S444 | SEQ ID NO: 1198 | 24 | 0.0 | 50525.0 | 51790.5 | 50527.2 50547.1 |
| SEQ ID NO: 248 | anti-hHER2-HC-P445-GDS-ppan-MC-MMAF-LSWLLRLLN-G446 | SEQ ID NO: 1199 | 10 | 2.0 | 50525.0 | 51790.5 | 51786.8 51915.6[g] 51729.6 |
| SEQ ID NO: 249 | anti-hHER2-HC-A118-DS-ppan-MC-MMAF-LEFIASKLA-S119 | SEQ ID NO: 1200 | 18 | 1.5 | 50331.8 | 51597.3 | 51598.4 51618.3 |
| SEQ ID NO: 250 | anti-hHER2-HC-S119-DS-ppan-MC-MMAF-LEFIASKLA-T120 | SEQ ID NO: 1201 | 15 | 1.6 | 50331.8 | 51597.3 | 51602.4 |
| SEQ ID NO: 251 | anti-hHER2-HC-T120-DS-ppan-MC-MMAF-LEFIASKLA-K121 | SEQ ID NO: 1202 | 27 | 2.0 | 50331.8 | 51597.3 | 51600.8 |
| SEQ ID NO: 257 | anti-hHER2-HC-S136-DS-ppan-MC-MMAF-LEFIASKLA-137 | SEQ ID NO: 1203 | 19 | 2.0 | 50331.8 | 51597.3 | 51603.2 |
| SEQ ID NO: 259 | anti-hHER2-HC-G138-DS-ppan-MC-MMAF-LEFIASKLA-T139 | SEQ ID NO: 1204 | 21 | 2.0 | 50331.8 | 51597.3 | 51601.6 |
| SEQ ID NO: 261 | anti-hHER2-HC-P153-DS-ppan-MC-MMAF-LEFIASKLA-V154 | SEQ ID NO: 1205 | 15 | 0.1 | 50331.8 | 51597.3 | 50339.6 |
| SEQ ID NO: 262 | anti-hHER2-HC-N159-DS-ppan-MC-MMAF-LEFIASKLA-S160 | SEQ ID NO: 1206 | 13 | n.d. | 50331.8 | 51597.3 | 50334.4 51600.4 |
| SEQ ID NO: 265 | anti-hHER2-HC-A162-DS-ppan-MC-MMAF-LEFIASKLA-L163 | SEQ ID NO: 1207 | 16 | 1.7 | 50331.8 | 51597.3 | 51598.3 51618.5 |

TABLE 21-continued

ADC preparation and characterization of material prepared on PEPP system.

| Antibody SEQ ID | ADC name[a] | ADC SEQ ID NO | Antibody yield[b] (mg/L) | DAR[c] | Expected mass antibody[d] (Da) | Expected mass ADC[e] (Da) | Observed mass[f] (Da) |
|---|---|---|---|---|---|---|---|
| SEQ ID NO: 267 | anti-hHER2-HC-T164-DS-ppan-MC-MMAF-LEFIASKLA-S165 | SEQ ID NO: 1208 | 18 | 1.2 | 50331.8 | 51597.3 | 51597.7 51616.8 |
| SEQ ID NO: 268 | anti-hHER2-HC-S165-DS-ppan-MC-MMAF-LEFIASKLA-G166 | SEQ ID NO: 1209 | 23 | 1.9 | 50331.8 | 51597.3 | 51595.2 |
| SEQ ID NO: 269 | anti-hHER2-HC-P171-DS-ppan-MC-MMAF-LEFIASKLA-A172 | SEQ ID NO: 1210 | 15 | 1.0 | 50331.8 | 51597.3 | 50332.9 50353.8 |
| SEQ ID NO: 270 | anti-hHER2-HC-S176-DS-ppan-MC-MMAF-LEFIASKLA-S177 | SEQ ID NO: 1211 | 13 | 0.1 | 50331.8 | 51597.3 | 50333.0 50354.0 |
| SEQ ID NO: 273 | anti-hHER2-HC-S190-DS-ppan-MC-MMAF-LEFIASKLA-S191 | SEQ ID NO: 1212 | 23 | 0.2 | 50331.8 | 51597.3 | 50333.6 51600.8 |
| SEQ ID NO: 274 | anti-hHER2-HC-S191-DS-ppan-MC-MMAF-LEFIASKLA-S192 | SEQ ID NO: 1213 | 24 | 1.6 | 50331.8 | 51597.3 | 51598.9 51620.3 |
| SEQ ID NO: 275 | anti-hHER2-HC-S192-DS-ppan-MC-MMAF-LEFIASKLA-L193 | SEQ ID NO: 1214 | 21 | 2.0 | 50331.8 | 51597.3 | 51598.4 51618.8 |
| SEQ ID NO: 277 | anti-hHER2-HC-G194-DS-ppan-MC-MMAF-LEFIASKLA-T195 | SEQ ID NO: 1215 | 14 | 1.6 | 50331.8 | 51597.3 | 51599.2 |
| SEQ ID NO: 278 | anti-hHER2-HC-T195-DS-ppan-MC-MMAF-LEFIASKLA-Q196 | SEQ ID NO: 1216 | 14 | 1.9 | 50331.8 | 51597.3 | 51599.0 51617.2 |
| SEQ ID NO: 279 | anti-hHER2-HC-Q196-DS-ppan-MC-MMAF-LEFIASKLA-T197 | SEQ ID NO: 1217 | 21 | 2.0 | 50331.8 | 51597.3 | 51598.1 51618.7 |
| SEQ ID NO: 280 | anti-hHER2-HC-K205-DS-ppan-MC-MMAF-LEFIASKLA-P206 | SEQ ID NO: 1218 | 24 | 0.0 | 50331.8 | 51597.3 | 50327.6 |
| SEQ ID NO: 281 | anti-hHER2-HC-P206-DS-ppan-MC-MMAF-LEFIASKLA-S207 | SEQ ID NO: 1219 | 23 | 0.0 | 50331.8 | 51597.3 | 50333.3 50354.7 |
| SEQ ID NO: 286 | anti-hHER2-HC-E233-DS-ppan-MC-MMAF-LEFIASKLA-L234 | SEQ ID NO: 1220 | 28 | 0.6 | 50331.8 | 51597.3 | 50330.8 51596.6 51615.6 |
| SEQ ID NO: 288 | anti-hHER2-HC-L235-DS-ppan-MC-MMAF-LEFIASKLA-G236 | SEQ ID NO: 1221 | 24 | 2.0 | 50331.8 | 51597.3 | 51596.7 51617.5 |
| SEQ ID NO: 289 | anti-hHER2-HC-G236-DS-ppan-MC-MMAF-LEFIASKLA-G237 | SEQ ID NO: 1222 | 22 | 1.3 | 50331.8 | 51597.3 | 51598.8 51620.7 |
| SEQ ID NO: 290 | anti-hHER2-HC-P244-DS-ppan-MC-MMAF-LEFIASKLA-P245 | SEQ ID NO: 1223 | 8 | 1.4 | 50331.8 | 51597.3 | 51596.8 51614.6 |
| SEQ ID NO: 291 | anti-hHER2-HC-P245-DS-ppan-MC-MMAF-LEFIASKLA-K246 | SEQ ID NO: 1224 | 22 | 1.0 | 50331.8 | 51597.3 | 50330.6 51595.9 50351.5 |
| SEQ ID NO: 292 | anti-hHER2-HC-I253-DS-ppan-MC-MMAF-LEFIASKLA-S254 | SEQ ID NO: 1225 | 0 | N/A | 50331.8 | 51597.3 | N/A |
| SEQ ID NO: 293 | anti-hHER2-HC-S254-DS-ppan-MC-MMAF-LEFIASKLA-R255 | SEQ ID NO: 1226 | 24 | 1.9 | 50331.8 | 51597.3 | 51596.6 51616.8 |
| SEQ ID NO: 294 | anti-hHER2-HC-R255-DS-ppan-MC-MMAF-LEFIASKLA-T256 | SEQ ID NO: 1227 | 21 | 2.0 | 50331.8 | 51597.3 | 51596.3 51616.5 |
| SEQ ID NO: 296 | anti-hHER2-HC-P257-DS-ppan-MC-MMAF-LEFIASKLA-E258 | SEQ ID NO: 1228 | 22 | 1.9 | 50331.8 | 51597.3 | 51596.3 51616.1 |
| SEQ ID NO: 297 | anti-hHER2-HC-S267-DS-ppan-MC-MMAF-LEFIASKLA-H268 | SEQ ID NO: 1229 | 23 | 0.2 | 50331.8 | 51597.3 | 51596.0 50330.9 51615.6 |
| SEQ ID NO: 298 | anti-hHER2-HC-H268-DS-ppan-MC-MMAF-LEFIASKLA-E269 | SEQ ID NO: 1230 | 22 | 0.7 | 50331.8 | 51597.3 | 51596.2 50331.0 51616.8 |
| SEQ ID NO: 299 | anti-hHER2-HC-E269-DS-ppan-MC-MMAF-LEFIASKLA-D270 | SEQ ID NO: 1231 | 17 | 1.8 | 50331.8 | 51597.3 | 51598.7 51620.0 |

TABLE 21-continued

ADC preparation and characterization of material prepared on PEPP system.

| Antibody SEQ ID | ADC name[a] | ADC SEQ ID NO | Antibody yield[b] (mg/L) | DAR[c] | Expected mass antibody[d] (Da) | Expected mass ADC[e] (Da) | Observed mass[f] (Da) |
|---|---|---|---|---|---|---|---|
| SEQ ID NO: 300 | anti-hHER2-HC-D270-DS-ppan-MC-MMAF-LEFIASKLA-P271 | SEQ ID NO: 1232 | 26 | 1.3 | 50331.8 | 51597.3 | 51596.4 51616.5 |
| SEQ ID NO: 301 | anti-hHER2-HC-P271-DS-ppan-MC-MMAF-LEFIASKLA-E272 | SEQ ID NO: 1233 | 22 | 1.7 | 50331.8 | 51597.3 | 51595.9 51615.4 |
| SEQ ID NO: 302 | anti-hHER2-HC-D280-DS-ppan-MC-MMAF-LEFIASKLA-G281 | SEQ ID NO: 1234 | 4 | 0.7 | 50331.8 | 51597.3 | 50330.8 51596.3 50351.7 |
| SEQ ID NO: 303 | anti-hHER2-HC-H285-DS-ppan-MC-MMAF-LEFIASKLA-N286 | SEQ ID NO: 1235 | 25 | 0.0 | 50331.8 | 51597.3 | 50331.0 50352.7 |
| SEQ ID NO: 304 | anti-hHER2-HC-N286-DS-ppan-MC-MMAF-LEFIASKLA-A287 | SEQ ID NO: 1236 | 20 | 0.0 | 50331.8 | 51597.3 | 50332.0 50354.1 |
| SEQ ID NO: 305 | anti-hHER2-HC-P291-DS-ppan-MC-MMAF-LEFIASKLA-R292 | SEQ ID NO: 1237 | 21 | 0.5 | 50331.8 | 51597.3 | 50333.5 51598.8 51620.0 |
| SEQ ID NO: 310 | anti-hHER2-HC-N315-DS-ppan-MC-MMAF-LEFIASKLA-G316 | SEQ ID NO: 1238 | 15 | n.d. | 50331.8 | 51597.3 | 50331.5 51596.8 50353.1 |
| SEQ ID NO: 311 | anti-hHER2-HC-G316-DS-ppan-MC-MMAF-LEFIASKLA-K317 | SEQ ID NO: 1239 | 9 | 1.1 | 50331.8 | 51597.3 | 51596.6 50331.0 51614.0 |
| SEQ ID NO: 312 | anti-hHER2-HC-K317-DS-ppan-MC-MMAF-LEFIASKLA-E318 | SEQ ID NO: 1240 | 10 | 0.8 | 50331.8 | 51597.3 | 50330.9 51596.3 50352.1 |
| SEQ ID NO: 313 | anti-hHER2-HC-K326-DS-ppan-MC-MMAF-LEFIASKLA-A327 | SEQ ID NO: 1241 | 15 | 0.0 | 50331.8 | 51597.3 | 50330.8 51597.2 |
| SEQ ID NO: 314 | anti-hHER2-HC-A327-DS-ppan-MC-MMAF-LEFIASKLA-L328 | SEQ ID NO: 1242 | 25 | 0.1 | 50331.8 | 51597.3 | 50333.6 50355.1 |
| SEQ ID NO: 315 | anti-hHER2-HC-L328-DS-ppan-MC-MMAF-LEFIASKLA-P329 | SEQ ID NO: 1243 | 13 | 1.9 | 50331.8 | 51597.3 | 51598.8 |
| SEQ ID NO: 316 | anti-hHER2-HC-P329-DS-ppan-MC-MMAF-LEFIASKLA-A330 | SEQ ID NO: 1244 | 7 | 0.9 | 50331.8 | 51597.3 | 51601.6 50334.8 |
| SEQ ID NO: 317 | anti-hHER2-HC-A330-DS-ppan-MC-MMAF-LEFIASKLA-P331 | SEQ ID NO: 1245 | 25 | 1.8 | 50331.8 | 51597.3 | 51602.4 |
| SEQ ID NO: 318 | anti-hHER2-HC-A339-DS-ppan-MC-MMAF-LEFIASKLA-K340 | SEQ ID NO: 1246 | 25 | 0.0 | 50331.8 | 51597.3 | 50333.6 |
| SEQ ID NO: 319 | anti-hHER2-HC-K340-DS-ppan-MC-MMAF-LEFIASKLA-G341 | SEQ ID NO: 1247 | 27 | 0.4 | 50331.8 | 51597.3 | 51600.4 50333.2 |
| SEQ ID NO: 320 | anti-hHER2-HC-G341-DS-ppan-MC-MMAF-LEFIASKLA-Q342 | SEQ ID NO: 1248 | 25 | 0.2 | 50331.8 | 51597.3 | 51599.9 50334.7 |
| SEQ ID NO: 321 | anti-hHER2-HC-Q342-DS-ppan-MC-MMAF-LEFIASKLA-P343 | SEQ ID NO: 1249 | 28 | 0.8 | 50331.8 | 51597.3 | 51599.8 50334.5 |
| SEQ ID NO: 322 | anti-hHER2-HC-P343-DS-ppan-MC-MMAF-LEFIASKLA-R344 | SEQ ID NO: 1250 | 24 | 1.9 | 50331.8 | 51597.3 | 51599.1 51615.8 |
| SEQ ID NO: 323 | anti-hHER2-HC-R344-DS-ppan-MC-MMAF-LEFIASKLA-E345 | SEQ ID NO: 1251 | 29 | 1.9 | 50331.8 | 51597.3 | 51600.1 51616.6 |
| SEQ ID NO: 325 | anti-hHER2-HC-E356-DS-ppan-MC-MMAF-LEFIASKLA-E357 | SEQ ID NO: 1252 | 20 | 0.8 | 50331.8 | 51597.3 | 51600.8 50335.1 51616.8 |
| SEQ ID NO: 327 | anti-hHER2-HC-M358-DS-ppan-MC-MMAF-LEFIASKLA-T359 | SEQ ID NO: 1253 | 26 | 0.2 | 50331.8 | 51597.3 | 50333.9 51599.4 |
| SEQ ID NO: 328 | anti-hHER2-HC-K360-DS-ppan-MC-MMAF-LEFIASKLA-N361 | SEQ ID NO: 1254 | 24 | 0.6 | 50331.8 | 51597.3 | 51599.9 51615.1 |
| SEQ ID NO: 329 | anti-hHER2-HC-N384-DS-ppan-MC-MMAF-LEFIASKLA-G385 | SEQ ID NO: 1255 | 24 | 0.0 | 50331.8 | 51597.3 | 50334.3 50354.2 |

TABLE 21-continued

ADC preparation and characterization of material prepared on PEPP system.

| Antibody SEQ ID | ADC name[a] | ADC SEQ ID NO | Antibody yield[b] (mg/L) | DAR[c] | Expected mass antibody[d] (Da) | Expected mass ADC[e] (Da) | Observed mass[f] (Da) |
|---|---|---|---|---|---|---|---|
| SEQ ID NO: 129 | anti-hHER2-HC-E388-DS-ppan-MC-MMAF-LEFIASKLA-N389 | SEQ ID NO: 1122 | 21 | 1.9 | 50331.8 | 51597.3 | 51601.2 |
| SEQ ID NO: 330 | anti-hHER2-HC-N389-DS-ppan-MC-MMAF-LEFIASKLA-N390 | SEQ ID NO: 1256 | 25 | 1.6 | 50331.8 | 51597.3 | 51600.1 51620.9 |
| SEQ ID NO: 332 | anti-hHER2-HC-P395-DS-ppan-MC-MMAF-LEFIASKLA-P396 | SEQ ID NO: 1257 | 25 | 0.0 | 50331.8 | 51597.3 | 50334.4 50352.8 |
| SEQ ID NO: 333 | anti-hHER2-HC-D399-DS-ppan-MC-MMAF-LEFIASKLA-S400 | SEQ ID NO: 1258 | 11 | 0.0 | 50331.8 | 51597.3 | 50335.1 50353.6 |
| SEQ ID NO: 335 | anti-hHER2-HC-D401-DS-ppan-MC-MMAF-LEFIASKLA-G402 | SEQ ID NO: 1259 | 23 | 0.0 | 50331.8 | 51597.3 | 50334.9 50353.0 |
| SEQ ID NO: 336 | anti-hHER2-HC-S415-DS-ppan-MC-MMAF-LEFIASKLA-R416 | SEQ ID NO: 1260 | 21 | 0.2 | 50331.8 | 51597.3 | 50335.0 51600.5 |
| SEQ ID NO: 337 | anti-hHER2-HC-R416-DS-ppan-MC-MMAF-LEFIASKLA-W417 | SEQ ID NO: 1261 | 15 | 1.9 | 50331.8 | 51597.3 | 51599.9 51615.8 |
| SEQ ID NO: 338 | anti-hHER2-HC-W417-DS-ppan-MC-MMAF-LEFIASKLA-Q418 | SEQ ID NO: 1262 | 9 | 0.2 | 50331.8 | 51597.3 | 50334.8 51599.9 50353.4 |
| SEQ ID NO: 339 | anti-hHER2-HC-Q418-DS-ppan-MC-MMAF-LEFIASKLA-Q419 | SEQ ID NO: 1263 | 22 | 0.5 | 50331.8 | 51597.3 | 51600.5 50335.2 51616.7 |
| SEQ ID NO: 340 | anti-hHER2-HC-Q419-DS-ppan-MC-MMAF-LEFIASKLA-G420 | SEQ ID NO: 1264 | 21 | 0.8 | 50331.8 | 51597.3 | 51600.0 51616.5 |
| SEQ ID NO: 341 | anti-hHER2-HC-G420-DS-ppan-MC-MMAF-LEFIASKLA-N421 | SEQ ID NO: 1265 | 22 | 1.1 | 50331.8 | 51597.3 | 51599.5 51616.0 |
| SEQ ID NO: 342 | anti-hHER2-HC-N421-DS-ppan-MC-MMAF-LEFIASKLA-V422 | SEQ ID NO: 1266 | 24 | 1.4 | 50331.8 | 51597.3 | 51600.6 51614.9 |
| SEQ ID NO: 343 | anti-hHER2-HC-H433-DS-ppan-MC-MMAF-LEFIASKLA-N434 | SEQ ID NO: 1267 | 26 | 0.0 | 50331.8 | 51597.3 | 50334.7 50276.2 |
| SEQ ID NO: 344 | anti-hHER2-HC-N434-DS-ppan-MC-MMAF-LEFIASKLA-H435 | SEQ ID NO: 1268 | 25 | 0.6 | 50331.8 | 51597.3 | 51592.4 50326.8 50268.8 |
| SEQ ID NO: 346 | anti-hHER2-HC-L443-DS-ppan-MC-MMAF-LEFIASKLA-S444 | SEQ ID NO: 1269 | 26 | 0.0 | 50331.8 | 51597.3 | 50334.5 50275.8 50353.4 |
| SEQ ID NO: 349 | anti-hHER2-HC-G446-DS-ppan-MC-MMAF-LEFIASKLA-K447 | SEQ ID NO: 1270 | 29 | 1.8 | 50331.8 | 51597.3 | 51595.2 |
| SEQ ID NO: 31 | anti-hHER2-LC-T109-GDS-ppan-MC-MMAF-LSWLLRLLN-V110 | SEQ ID NO: 1271 | 34 | 1.4 | 24811.6 | 26077.1 | 26077.8 26058.3 26096.4 |
| SEQ ID NO: 32 | anti-hHER2-LC-V110-GDS-ppan-MC-MMAF-LSWLLRLLN-A111 | SEQ ID NO: 1272 | 5 | 1.9 | 24811.6 | 26077.1 | 26076.4 |
| SEQ ID NO: 33 | anti-hHER2-LC-A111-GDS-ppan-MC-MMAF-LSWLLRLLN-A112 | SEQ ID NO: 1273 | 13 | 2.0 | 24811.6 | 26077.1 | 26075.6 |
| SEQ ID NO: 34 | anti-hHER2-LC-P119-GDS-ppan-MC-MMAF-LSWLLRLLN-P120 | SEQ ID NO: 1274 | 1 | N/A | 24811.6 | 26077.1 | N/A |
| SEQ ID NO: 37 | anti-hHER2-LC-D122-GDS-ppan-MC-MMAF-LSWLLRLLN-E123 | SEQ ID NO: 1275 | 1 | N/A | 24811.6 | 26077.1 | N/A |
| SEQ ID NO: 38 | anti-hHER2-LC-Y140-GDS-ppan-MC-MMAF-LSWLLRLLN-P141 | SEQ ID NO: 1276 | 3 | 0.8 | 24811.6 | 26077.1 | 26077.2 |
| SEQ ID NO: 39 | anti-hHER2-LC-P141-GDS-ppan-MC-MMAF-LSWLLRLLN-R142 | SEQ ID NO: 1277 | 3 | 0.3 | 24811.6 | 26077.1 | 26076.8 |
| SEQ ID NO: 40 | anti-hHER2-LC-R142-GDS-ppan-MC-MMAF-LSWLLRLLN-E143 | SEQ ID NO: 1278 | 5 | 0.3 | 24811.6 | 26077.1 | 26077.7 24811.8 26097.2 |

TABLE 21-continued

ADC preparation and characterization of material prepared on PEPP system.

| Antibody SEQ ID | ADC name[a] | ADC SEQ ID NO | Antibody yield[b] (mg/L) | DAR[c] | Expected mass antibody[d] (Da) | Expected mass ADC[e] (Da) | Observed mass[f] (Da) |
|---|---|---|---|---|---|---|---|
| SEQ ID NO: 41 | anti-hHER2-LC-E143-GDS-ppan-MC-MMAF-LSWLLRLLN-A144 | SEQ ID NO: 1279 | 6 | 0.4 | 24811.6 | 26077.1 | 26075.6 26097.6 |
| SEQ ID NO: 42 | anti-hHER2-LC-D151-GDS-ppan-MC-MMAF-LSWLLRLLN-N152 | SEQ ID NO: 1280 | 16 | 0.3 | 24811.6 | 26077.1 | 24811.7 26077.3 24829.7 |
| SEQ ID NO: 43 | anti-hHER2-LC-N152-GDS-ppan-MC-MMAF-LSWLLRLLN-A153 | SEQ ID NO: 1281 | 5 | 1.0 | 24811.6 | 26077.1 | 26077.2 |
| SEQ ID NO: 44 | anti-hHER2-LC-A153-GDS-ppan-MC-MMAF-LSWLLRLLN-L154 | SEQ ID NO: 1282 | 13 | 1.9 | 24811.6 | 26077.1 | 26077.7 26096.6 |
| SEQ ID NO: 45 | anti-hHER2-LC-L154-GDS-ppan-MC-MMAF-LSWLLRLLN-Q155 | SEQ ID NO: 1283 | 21 | 1.2 | 24811.6 | 26077.1 | 26078.2 26096.9 |
| SEQ ID NO: 46 | anti-hHER2-LC-Q155-GDS-ppan-MC-MMAF-LSWLLRLLN-S156 | SEQ ID NO: 1284 | 14 | 2.0 | 24811.6 | 26077.1 | 26075.2 |
| SEQ ID NO: 47 | anti-hHER2-LC-E161-GDS-ppan-MC-MMAF-LSWLLRLLN-S162 | SEQ ID NO: 1285 | 19 | 1.9 | 24811.6 | 26077.1 | 26077.6 26097.6 |
| SEQ ID NO: 48 | anti-hHER2-LC-S162-GDS-ppan-MC-MMAF-LSWLLRLLN-V163 | SEQ ID NO: 1286 | 17 | 0.7 | 24811.6 | 26077.1 | 26077.2 |
| SEQ ID NO: 50 | anti-hHER2-LC-T164-GDS-ppan-MC-MMAF-LSWLLRLLN-E165 | SEQ ID NO: 1287 | 14 | 0.0 | 24811.6 | 26077.1 | 24810.0 |
| SEQ ID NO: 51 | anti-hHER2-LC-E165-GDS-ppan-MC-MMAF-LSWLLRLLN-Q166 | SEQ ID NO: 1288 | 0 | N/A | 24811.6 | 26077.1 | N/A |
| SEQ ID NO: 52 | anti-hHER2-LC-Q166-GDS-ppan-MC-MMAF-LSWLLRLLN-D167 | SEQ ID NO: 1289 | 17 | 0.0 | 24811.6 | 26077.1 | 24810.4 24832.4 |
| SEQ ID NO: 53 | anti-hHER2-LC-D167-GDS-ppan-MC-MMAF-LSWLLRLLN-S168 | SEQ ID NO: 1290 | 24 | 0.7 | 24811.6 | 26077.1 | 26077.4 24812.3 26096.5 |
| SEQ ID NO: 54 | anti-hHER2-LC-T197-GDS-ppan-MC-MMAF-LSWLLRLLN-H198 | SEQ ID NO: 1291 | 8 | 1.2 | 24811.6 | 26077.1 | 24812.0 26077.9 24831.4 |
| SEQ ID NO: 56 | anti-hHER2-LC-Q199-GDS-ppan-MC-MMAF-LSWLLRLLN-G200 | SEQ ID NO: 1292 | 5 | 1.9 | 24811.6 | 26077.1 | 26076.0 |
| SEQ ID NO: 59 | anti-hHER2-LC-S202-GDS-ppan-MC-MMAF-LSWLLRLLN-S203 | SEQ ID NO: 1293 | 8 | 2.0 | 24811.6 | 26077.1 | 26077.4 26095.9 |
| SEQ ID NO: 63 | anti-hHER2-LC-V110-DS-ppan-MC-MMAF-LEFIASKLA-A111 | SEQ ID NO: 1294 | 15 | 2.0 | 24618.4 | 25883.9 | 25883.2 |
| SEQ ID NO: 64 | anti-hHER2-LC-A111-DS-ppan-MC-MMAF-LEFIASKLA-A112 | SEQ ID NO: 1295 | 17 | 1.6 | 24618.4 | 25883.9 | 25881.2 |
| SEQ ID NO: 65 | anti-hHER2-LC-P119-DS-ppan-MC-MMAF-LEFIASKLA-P120 | SEQ ID NO: 1296 | 13 | 0.0 | 24618.4 | 25883.9 | 24618.1 24637.6 |
| SEQ ID NO: 66 | anti-hHER2-LC-P120-DS-ppan-MC-MMAF-LEFIASKLA-S121 | SEQ ID NO: 1297 | 9 | 0.0 | 24618.4 | 25883.9 | 24617.2 |
| SEQ ID NO: 67 | anti-hHER2-LC-S121-DS-ppan-MC-MMAF-LEFIASKLA-D122 | SEQ ID NO: 1298 | 4 | 0.0 | 24618.4 | 25883.9 | 24616.8 |
| SEQ ID NO: 68 | anti-hHER2-LC-D122-DS-ppan-MC-MMAF-LEFIASKLA-E123 | SEQ ID NO: 1299 | 2 | 0.0 | 24618.4 | 25883.9 | 24616.8 |
| SEQ ID NO: 69 | anti-hHER2-LC-Y140-DS-ppan-MC-MMAF-LEFIASKLA-P141 | SEQ ID NO: 1300 | 5 | 0.1 | 24618.4 | 25883.9 | 24616.4 |
| SEQ ID NO: 71 | anti-hHER2-LC-R142-DS-ppan-MC-MMAF-LEFIASKLA-E143 | SEQ ID NO: 1301 | 13 | 0.1 | 24618.4 | 25883.9 | 24618.8 25884.0 24639.3 |
| SEQ ID NO: 72 | anti-hHER2-LC-E143-DS-ppan-MC-MMAF-LEFIASKLA-A144 | SEQ ID NO: 1302 | 10 | 0.0 | 24618.4 | 25883.9 | 24616.8 |

TABLE 21-continued

ADC preparation and characterization of material prepared on PEPP system.

| Antibody SEQ ID | ADC name[a] | ADC SEQ ID NO | Antibody yield[b] (mg/L) | DAR[c] | Expected mass antibody[d] (Da) | Expected mass ADC[e] (Da) | Observed mass[f] (Da) |
|---|---|---|---|---|---|---|---|
| SEQ ID NO: 73 | anti-hHER2-LC-D151-DS-ppan-MC-MMAF-LEFIASKLA-N152 | SEQ ID NO: 1303 | 17 | 0.0 | 24618.4 | 25883.9 | 24617.2 |
| SEQ ID NO: 74 | anti-hHER2-LC-N152-DS-ppan-MC-MMAF-LEFIASKLA-A153 | SEQ ID NO: 1304 | 17 | 0.0 | 24618.4 | 25883.9 | 24616.8 |
| SEQ ID NO: 75 | anti-hHER2-LC-A153-DS-ppan-MC-MMAF-LEFIASKLA-L154 | SEQ ID NO: 1305 | 20 | 1.8 | 24618.4 | 25883.9 | 25882.8 |
| SEQ ID NO: 76 | anti-hHER2-LC-L154-DS-ppan-MC-MMAF-LEFIASKLA-Q155 | SEQ ID NO: 1306 | 25 | 0.6 | 24618.4 | 25883.9 | 25884.6 24618.9 25904.2 |
| SEQ ID NO: 77 | anti-hHER2-LC-Q155-DS-ppan-MC-MMAF-LEFIASKLA-S156 | SEQ ID NO: 1307 | 27 | 1.1 | 24618.4 | 25883.9 | 25883.9 24619.0 25903.2 |
| SEQ ID NO: 79 | anti-hHER2-LC-S162-DS-ppan-MC-MMAF-LEFIASKLA-V163 | SEQ ID NO: 1308 | 7 | 0.0 | 24618.4 | 25883.9 | 24616.4 |
| SEQ ID NO: 81 | anti-hHER2-LC-T164-DS-ppan-MC-MMAF-LEFIASKLA-E165 | SEQ ID NO: 1309 | 10 | 0.0 | 24618.4 | 25883.9 | 24616.4 |
| SEQ ID NO: 82 | anti-hHER2-LC-E165-DS-ppan-MC-MMAF-LEFIASKLA-Q166 | SEQ ID NO: 1310 | 29 | 0.0 | 24618.4 | 25883.9 | 24618.9 24639.4 |
| SEQ ID NO: 83 | anti-hHER2-LC-Q166-DS-ppan-MC-MMAF-LEFIASKLA-D167 | SEQ ID NO: 1311 | 20 | 0.0 | 24618.4 | 25883.9 | 24617.2 |
| SEQ ID NO: 84 | anti-hHER2-LC-D167-DS-ppan-MC-MMAF-LEFIASKLA-S168 | SEQ ID NO: 1312 | 28 | 0.0 | 24618.4 | 25883.9 | 24618.8 24639.0 |
| SEQ ID NO: 85 | anti-hHER2-LC-T197-DS-ppan-MC-MMAF-LEFIASKLA-H198 | SEQ ID NO: 1313 | 5 | 0.0 | 24618.4 | 25883.9 | 24615.2 |
| SEQ ID NO: 87 | anti-hHER2-LC-Q199-DS-ppan-MC-MMAF-LEFIASKLA-G200 | SEQ ID NO: 1314 | 7 | 0.0 | 24618.4 | 25883.9 | 24617.2 |
| SEQ ID NO: 88 | anti-hHER2-LC-G200-DS-ppan-MC-MMAF-LEFIASKLA-L201 | SEQ ID NO: 1315 | 18 | 0.2 | 24618.4 | 25883.9 | 24618.8 25884.4 24638.9 |
| SEQ ID NO: 89 | anti-hHER2-LC-L201-DS-ppan-MC-MMAF-LEFIASKLA-S202 | SEQ ID NO: 1316 | 15 | 0.8 | 24618.4 | 25883.9 | 25884.0 |

[a]Name represents part of the HC or LC that contains the peptide tag with the attached compound, the paired wildtype chain is not listed.
[b]Yield of antibody per liter culture (based on 35 mL cultures) measured after protein A purification.
[c]Drug-to-antibody ratio according to HPLC.
[d]Mass in Dalton as predicted for the antibody.
[e]Mass in Dalton as predicted for the ADC.
[f]Mass in Dalton as detected on an Agilent 6520 Q-TOF instrument (Agilent Technologies). Most prominent observation is listed first.
[g]Observed mass corresponds to non-clipped C-terminal lysine residue of heavy chain.
n.d., not determined. The drug-to-antibody ratio could not be determined accurately be HPLC because of peak overlap.
N/A, not applicable. Conjugation was not attempted or data could not be obtained because of low yield.

Example 25

Scale Up of Selected Peptide Tagged ADCs for Pharmacokinetic (PK) Studies and Further Characterization The PEPP system does not provide enough quantities of peptide-tagged ADCs for PK studies. Subsequently, expression of 39 constructs (Table 22) selected from among the 183 antibodies tested in Example 24 (Table 21) was scaled up to 200-400 mL culture volume. Selection criteria for scale-up were high conjugation efficiency, reasonable expression yield, confirmed in vitro potency, and low aggregation level as observed for the ADCs prepared in Example 24.

After expression of the selected S6/ybbR-tagged antibodies in Freestyle™ expression media (Invitrogen) for five days at 3TC under 5% $CO_2$, the cultures were harvested by centrifugation, and the resulting medium supernatants were passed through 0.22 μm filters (EMD Millipore). Antibody expression was verified by SDS-PAGE analysis. Next, the filtrates were loaded at a flowrate of 0.5-1 mL/min onto PBS-equilibrated columns containing 0.5 mL of Protein A resin by using a MINIPULS Evolution peristaltic pump (Gilson Inc.). After washing the columns with 100-200 column volumes of PBS, the antibody constructs were eluted with 0.1 M sodium acetate (pH 3.0) in two 2.5 mL fractions. Both fractions were immediately neutralized with 25-38% (v/v) of Tris-HCl buffer (1 M, pH 8.0). In order to determine the yield of the Protein A-purified antibodies (Table 22), protein concentrations of the eluates were measured in duplicate on a ND-1000 UV-Vis Spectrophotometer (NanoDrop Technologies) at 280 nm according to the preset molar extinction coefficient for IgG molecules. Using Slide-A-Lyzer Dialysis Cassettes (3.5-7.0 kDa cut-off, Pierce), the second elution fraction of each construct was dialyzed into PBS for subsequent thermostability measurements of non-conjugated antibodies by DSF (Table 23). The first elution fraction of each peptide-tagged antibody was dialyzed into conjugation buffer (75 mM Tris-HCl buffer at pH 8.0 supplemented with 20 mM NaCl and 12.5 mM $MgCl_2$). After adjusting the antibody concentration to 2.5 µM, conjugation reactions were initiated by addition of CoA-MC-MMAF and Sfp enzyme to final concentrations of 30-60 µM and 1-4 µM, respectively. The enzymatic reaction was allowed to proceed for about 20 hours at room temperature, before verifying the degree of labeling by analytical reverse-phase HPLC using the respective uncoupled antibody as control (Table 22). All conjugation reactions were analyzed by mass spectrometry on an Agilent 6520 Q-TOF instrument (Table 22). After confirming near quantitative conjugation, reaction mixtures were concentrated to a final volume of 1 mL using 30 kDa cut-off Amicon Ultra centrifugal filter devices (EMD Millipore). Following removal of precipitate by centrifugation, Sfp enzyme and excess CoA-MC-MMAF substrate were removed by SEC (size-exclusion chromatography) on a HiLoad 26/60 Superdex 200 prep grade column (GE Healthcare) in PBS at a flowrate of 1 mL/min. The purity of the peptide-tagged ADCs after SEC was assessed by reverse-phase HPLC. After 0.22 µM filtration, the final yields of the ADCs were determined using triplicate measurements on a ND-1000 UV-Vis Spectrophotometer (NanoDrop Technologies) as above (Table 22).

TABLE 22

ADC production and characterization from 200-400 mL scale-up culture.

| Antibody SEQ ID | ADC name[a] | ADC SEQ ID NO | Antibody yield[b] (mg/L) | ADC yield[c] (mg/L) | DAR[d] | Monomer[e] (%) | Expt. mass[f] (Da) | Obs. mass[g] (Da) |
|---|---|---|---|---|---|---|---|---|
| SEQ ID NO: 151 | anti-hHER2-HC-S119-GDS-ppan-MC-MMAF-LSWLLRLLN-T120 | SEQ ID NO: 1137 | 57 | 31 | 2.0 | 97 | 51790.5 | 51786.4 |
| SEQ ID NO: 152 | anti-hHER2-HC-T120-GDS-ppan-MC-MMAF-LSWLLRLLN-K121 | SEQ ID NO: 1138 | 40 | 23 | 2.0 | 100 | 51790.5 | 51796.4 |
| SEQ ID NO: 157 | anti-hHER2-HC-T135-GDS-ppan-MC-MMAF-LSWLLRLLN-S136 | SEQ ID NO: 1139 | 41 | 20 | 2.0 | 100 | 51790.5 | 51785.2 |
| SEQ ID NO: 158 | anti-hHER2-HC-S136-GDS-ppan-MC-MMAF-LSWLLRLLN-G137 | SEQ ID NO: 1140 | 40 | 20 | 2.0 | 100 | 51790.5 | 51785.6 |
| SEQ ID NO: 166 | anti-hHER2-HC-A162-GDS-ppan-MC-MMAF-LSWLLRLLN-L163 | SEQ ID NO: 1147 | 25 | 16 | 2.0 | 100 | 51790.5 | 51791.6 |
| SEQ ID NO: 168 | anti-hHER2-HC-T164-GDS-ppan-MC-MMAF-LSWLLRLLN-S165 | SEQ ID NO: 1148 | 32 | 15 | 2.0 | 100 | 51790.5 | 51787.6 |
| SEQ ID NO: 169 | anti-hHER2-HC-S165-GDS-ppan-MC-MMAF-LSWLLRLLN-G166 | SEQ ID NO: 1149 | 39 | 21 | 2.0 | 100 | 51790.5 | 51786.4 |
| SEQ ID NO: 173 | anti-hHER2-HC-P189-GDS-ppan-MC-MMAF-LSWLLRLLN-S190 | SEQ ID NO: 1152 | 36 | 25 | 2.0 | 100 | 51790.5 | 51792.0 |
| SEQ ID NO: 178 | anti-hHER2-HC-G194-GDS-ppan-MC-MMAF-LSWLLRLLN-T195 | SEQ ID NO: 1156 | 35 | 21 | 2.0 | 100 | 51790.5 | 51794.8 |
| SEQ ID NO: 179 | anti-hHER2-HC-T195-GDS-ppan-MC-MMAF-LSWLLRLLN-Q196 | SEQ ID NO: 1157 | 39 | 21 | 1.9 | 100 | 51790.5 | 51790.4 |
| SEQ ID NO: 202 | anti-hHER2-HC-P271-GDS-ppan-MC-MMAF-LSWLLRLLN-E272 | SEQ ID NO: 1172 | 9 | 4 | 1.9 | 100 | 51790.5 | 51782.0 |
| SEQ ID NO: 218 | anti-hHER2-HC-A330-GDS-ppan-MC-MMAF-LSWLLRLLN-P331 | SEQ ID NO: 1181 | 30 | 14 | 1.8 | 100 | 51790.5 | 51796.4 50526.8[h] |
| SEQ ID NO: 220 | anti-hHER2-HC-K340-GDS-ppan-MC-MMAF-LSWLLRLLN-G341 | SEQ ID NO: 1182 | 20 | 9 | 2.0 | 100 | 51790.5 | 51794.4 51918.4[i] |
| SEQ ID NO: 221 | anti-hHER2-HC-G341-GDS-ppan-MC-MMAF-LSWLLRLLN-Q342 | SEQ ID NO: 1183 | 47 | 26 | 1.9 | 100 | 51790.5 | 51794.8 |
| SEQ ID NO: 224 | anti-hHER2-HC-R344-GDS-ppan-MC-MMAF-LSWLLRLLN-E345 | SEQ ID NO: 1186 | 37 | 21 | 2.0 | 100 | 51790.5 | 51795.6 |
| SEQ ID NO: 229 | anti-hHER2-HC-K360-GDS-ppan-MC-MMAF-LSWLLRLLN-N361 | SEQ ID NO: 1187 | 46 | 21 | 1.9 | 100 | 51790.5 | 51785.2 |
| SEQ ID NO: 127 | anti-hHER2-HC-E388-GDS-ppan-MC-MMAF-LSWLLRLLN-N389 | SEQ ID NO: 1118 | 40 | 25 | 2.0 | 100 | 51790.5 | 51792.4 |

TABLE 22-continued

ADC production and characterization from 200-400 mL scale-up culture.

| Antibody SEQ ID | ADC name[a] | ADC SEQ ID NO | Antibody yield[b] (mg/L) | ADC yield[c] (mg/L) | DAR[d] | Monomer[e] (%) | Expt. mass[f] (Da) | Obs. mass[g] (Da) |
|---|---|---|---|---|---|---|---|---|
| SEQ ID NO: 239 | anti-hHER2-HC-Q418-GDS-ppan-MC-MMAF-LSWLLRLLN-Q419 | SEQ ID NO: 1195 | 55 | 26 | 2.0 | 100 | 51790.5 | 51786.8 51914.4[i] |
| SEQ ID NO: 244 | anti-hHER2-HC-N434-GDS-ppan-MC-MMAF-LSWLLRLLN-H435 | SEQ ID NO: 1197 | 41 | 10 | 1.9 | n.d. | 51790.5 | 51785.2 51912.8[i] |
| SEQ ID NO: 248 | anti-hHER2-HC-P445-GDS-ppan-MC-MMAF-LSWLLRLLN-G446 | SEQ ID NO: 1199 | 9 | 3 | 1.9 | 100 | 51790.5 | 51783.2 51910.8[i] |
| SEQ ID NO: 250 | anti-hHER2-HC-S119-DS-ppan-MC-MMAF-LEFIASKLA-T120 | SEQ ID NO: 1201 | 35 | 25 | 1.9 | 100 | 51597.3 | 51591.2 |
| SEQ ID NO: 251 | anti-hHER2-HC-T120-DS-ppan-MC-MMAF-LEFIASKLA-K121 | SEQ ID NO: 1202 | 42 | 24 | 1.9 | 100 | 51597.3 | 51592.4 |
| SEQ ID NO: 257 | anti-hHER2-HC-S136-DS-ppan-MC-MMAF-LEFIASKLA-137 | SEQ ID NO: 1203 | 33 | 20 | 1.9 | 100 | 51597.3 | 51602.0 |
| SEQ ID NO: 259 | anti-hHER2-HC-G138-DS-ppan-MC-MMAF-LEFIASKLA-T139 | SEQ ID NO: 1204 | 26 | 14 | 1.9 | 100 | 51597.3 | 51592.0 |
| SEQ ID NO: 268 | anti-hHER2-HC-S165-DS-ppan-MC-MMAF-LEFIASKLA-G166 | SEQ ID NO: 1209 | 33 | 21 | 1.9 | 100 | 51597.3 | 51595.2 |
| SEQ ID NO: 277 | anti-hHER2-HC-G194-DS-ppan-MC-MMAF-LEFIASKLA-T195 | SEQ ID NO: 1215 | 24 | 14 | 1.9 | 100 | 51597.3 | 51592.4 |
| SEQ ID NO: 315 | anti-hHER2-HC-L328-DS-ppan-MC-MMAF-LEFIASKLA-P329 | SEQ ID NO: 1243 | 35 | 22 | 1.9 | 100 | 51597.3 | 51600.4 |
| SEQ ID NO: 317 | anti-hHER2-HC-A330-DS-ppan-MC-MMAF-LEFIASKLA-P331 | SEQ ID NO: 1245 | 20 | 12 | 1.8 | 100 | 51597.3 | 51589.2 50323.6[h] |
| SEQ ID NO: 129 | anti-hHER2-HC-E388-DS-ppan-MC-MMAF-LEFIASKLA-N389 | SEQ ID NO: 1122 | 51 | 28 | 1.9 | 100 | 51597.3 | 51592.0 |
| SEQ ID NO: 349 | anti-hHER2-HC-G446-DS-ppan-MC-MMAF-LEFIASKLA-K447 | SEQ ID NO: 1270 | 37 | 23 | 1.9 | 100 | 51597.3 | 51590.4 |
| SEQ ID NO: 32 | anti-hHER2-LC-V110-GDS-ppan-MC-MMAF-LSWLLRLLN-A111 | SEQ ID NO: 1272 | 8 | 3 | 2.0 | 93 | 26077.1 | 26074.8 |
| SEQ ID NO: 33 | anti-hHER2-LC-A111-GDS-ppan-MC-MMAF-LSWLLRLLN-A112 | SEQ ID NO: 1273 | 20 | 13 | 2.0 | 100 | 26077.1 | 26073.6 |
| SEQ ID NO: 46 | anti-hHER2-LC-Q155-GDS-ppan-MC-MMAF-LSWLLRLLN-S156 | SEQ ID NO: 1284 | 29 | 19 | 1.9 | 100 | 26077.1 | 26070.8 |
| SEQ ID NO: 48 | anti-hHER2-LC-S162-GDS-ppan-MC-MMAF-LSWLLRLLN-V163 | SEQ ID NO: 1251 | 9 | 5 | 1.9 | 100 | 26077.1 | 26076.0 |
| SEQ ID NO: 56 | anti-hHER2-LC-Q199-GDS-ppan-MC-MMAF-LSWLLRLLN-G200 | SEQ ID NO: 1292 | 10 | 3 | 1.9 | 100 | 26077.1 | 26074.4 |
| SEQ ID NO: 63 | anti-hHER2-LC-V110-DS-ppan-MC-MMAF-LEFIASKLA-A111 | SEQ ID NO: 1294 | 53 | 30 | 1.9 | 100 | 25883.9 | 25880.8 |
| SEQ ID NO: 64 | anti-hHER2-LC-A111-DS-ppan-MC-MMAF-LEFIASKLA-A112 | SEQ ID NO: 1295 | 12 | 8 | 1.9 | 100 | 25883.9 | 25880.4 25901.2[j] |
| SEQ ID NO: 75 | anti-hHER2-LC-A153-DS-ppan-MC-MMAF-LEFIASKLA-L154 | SEQ ID NO: 1305 | 14 | 7 | 1.9 | 100 | 25883.9 | 25878.0 |

TABLE 22-continued

ADC production and characterization from 200-400 mL scale-up culture.

| Antibody SEQ ID | ADC name[a] | ADC SEQ ID NO | Antibody yield[b] (mg/L) | ADC yield[c] (mg/L) | DAR[d] | Monomer[e] (%) | Expt. mass[f] (Da) | Obs. mass[g] (Da) |
|---|---|---|---|---|---|---|---|---|
| SEQ ID NO: 89 | anti-hHER2-LC-L201-DS-ppan-MC-MMAF-LEFIASKLA-S202 | SEQ ID NO: 1316 | 26 | 15 | 1.8 | 100 | 25883.9 | 25881.2 |

[a]Name represents part of the HC or LC that contains the peptide tag with the attached compound, the paired wildtype chain is not listed.
[b]Yield of antibody per liter culture (based on 200-400 mL cultures) measured after protein A purification.
[c]Yield of ADC per liter of culture measured after size-exclusion chromatography.
[d]Drug-to-antibody ratio according to HPLC.
[e]Analytical size exclusion chromatography results for ADC (percent of monomer).
[f]Mass in Dalton as predicted for the ADC.
[g]Mass in Dalton as detected on an Agilent 6520 Q-TOF instrument (Agilent Technologies). Most prominent observation is listed first.
[h]Observed mass corresponds to non-conjugated antibody.
[i]Observed mass corresponds to non-clipped C-terminal lysine residue of heavy chain.
[j]Observed mass presumably corresponds to sodium adduct.
n.d., not determined.

Expression levels of the selected peptide-tagged antibodies averaged 32 mg per liter of cell culture (ranging from 8 to 57 mg/L)(Table 22) and the final yield of purified ADC averaged 17 mg per liter of cell culture (ranging from 3 to 31 mg/L)(Table 22). All ADCs were site-specifically conjugated with two CoA-MC-MMAF molecules (DAR=1.8 to 2) as verified by HPLC and MS (Table 22). No aggregation or oligomeric species were detected for 36 of 39 ADCs prepared (Table 22). All ADCs were more than 93% monomeric as determined by analytical size exclusion chromatography. The thermal stability of nonconjugated antibodies and ADCs was characterized by DSF (Table 23). For wild-type trastuzumab, two DSF thermal melting transitions (Tm1 and Tm2) were observed at 69.7 and 81.2° C. For 29 of 39 peptide-tagged antibodies, both transitions were within less than 3° C. of what was observed for wild-type trastuzumab. Conjugation of CoA-MC-MMAF had no significant effect on Tm2 but lowered Tm1 of the ADC by on average 1° C. relative to the nonconjugated antibody (Table 23). For 11 antibodies (and ADCs), the thermal stability was significantly reduced relative to wild-type trastuzumab as illustrated by the difference in Tm1. This transition is attributed to the unfolding of the CH2 domain of an IgG and indeed most of the antibodies that are destabilized (SEQ ID NO: 202, 218, 220, 221, 224, 315 and 317) have the peptide-tag inserted at positions in the CH2 domain. As stated above, the location of the peptide-tag can significantly affect the properties of the resulting antibody and ADC.

TABLE 23

Thermal stability of modified antibodies and ADCs as determined by differential scanning fluorometry.

| Antibody SEQ ID: | ADC name[a] | ADC SEQ ID NO | Antibody Tm1 (° C.) | Antibody Tm2 (° C.) | ADC Tm1 (° C.) | ADC Tm2 (° C.) | ΔTm1[b] (° C.) | ΔTm2[b] (° C.) | Ab − WT ΔTm1[c] (° C.) |
|---|---|---|---|---|---|---|---|---|---|
| SEQ ID NO: 151 | anti-hHER2-HC-S119-GDS-ppan-MC-MMAF-LSWLLRLLN-T120 | SEQ ID NO: 1137 | 69.8 | t.b. | 69.2 | t.b. | −0.6 | t.b. | 0.1 |
| SEQ ID NO: 152 | anti-hHER2-HC-T120-GDS-ppan-MC-MMAF-LSWLLRLLN-K121 | SEQ ID NO: 1138 | 69.1 | t.b. | 68.8 | t.b. | −0.3 | t.b. | −0.6 |
| SEQ ID NO: 157 | anti-hHER2-HC-T135-GDS-ppan-MC-MMAF-LSWLLRLLN-S136 | SEQ ID NO: 1139 | 67.6 | 81.3 | 67.1 | 81.2 | −0.5 | −0.1 | −2.1 |
| SEQ ID NO: 158 | anti-hHER2-HC-S136-GDS-ppan-MC-MMAF-LSWLLRLLN-G137 | SEQ ID NO: 1140 | 67.9 | 81.3 | 67.3 | 81.3 | −0.6 | 0 | −1.8 |
| SEQ ID NO: 166 | anti-hHER2-HC-A162-GDS-ppan-MC-MMAF-LSWLLRLLN-L163 | SEQ ID NO: 1147 | 69.3 | 80.0 | 68.9 | 79.8 | −0.3 | −0.2 | −0.4 |
| SEQ ID NO: 168 | anti-hHER2-HC-T164-GDS-ppan-MC-MMAF-LSWLLRLLN-S165 | SEQ ID NO: 1148 | 68.9 | 80.4 | 68.8 | 80.5 | −0.2 | 0.1 | −0.8 |
| SEQ ID NO: 169 | anti-hHER2-HC-S165-GDS-ppan-MC-MMAF-LSWLLRLLN-G166 | SEQ ID NO: 1149 | 69.2 | 80.4 | 68.8 | 80.2 | −0.4 | −0.2 | −0.5 |
| SEQ ID NO: 173 | anti-hHER2-HC-P189-GDS-ppan-MC-MMAF-LSWLLRLLN-S190 | SEQ ID NO: 1152 | 69.0 | 80.5 | 68.3 | 80.4 | −0.7 | −0.2 | −0.7 |
| SEQ ID NO: 178 | anti-hHER2-HC-G194-GDS-ppan-MC-MMAF-LSWLLRLLN-T195 | SEQ ID NO: 1156 | 68.7 | 80.8 | 67.6 | 80.9 | −1.1 | 0.1 | −1.0 |

TABLE 23-continued

Thermal stability of modified antibodies and ADCs as determined by differential scanning fluorometry.

| Antibody SEQ ID: | ADC name[a] | ADC SEQ ID NO | Antibody Tm1 (° C.) | Antibody Tm2 (° C.) | ADC Tm1 (° C.) | ADC Tm2 (° C.) | ΔTm1[b] (° C.) | ΔTm2[b] (° C.) | Ab – WT ΔTm1[c] (° C.) |
|---|---|---|---|---|---|---|---|---|---|
| SEQ ID NO: 179 | anti-hHER2-HC-T195-GDS-ppan-MC-MMAF-LSWLLRLLN-Q196 | SEQ ID NO: 1157 | 69.3 | 81.1 | 68.8 | 80.9 | −0.5 | −0.1 | −0.4 |
| SEQ ID NO: 202 | anti-hHER2-HC-P271-GDS-ppan-MC-MMAF-LSWLLRLLN-E272 | SEQ ID NO: 1172 | 53.4 | 81.6 | 51.2 | 81.2 | −2.2 | −0.4 | −16.3 |
| SEQ ID NO: 218 | anti-hHER2-HC-A330-GDS-ppan-MC-MMAF-LSWLLRLLN-P331 | SEQ ID NO: 1181 | 52.5 | 81.5 | 49.0 | 81.1 | −3.5 | −0.3 | −17.2 |
| SEQ ID NO: 220 | anti-hHER2-HC-K340-GDS-ppan-MC-MMAF-LSWLLRLLN-G341 | SEQ ID NO: 1182 | 65.2 | 77.3 | 58.7 | 81.0 | −6.5 | 3.7 | −4.5 |
| SEQ ID NO: 221 | anti-hHER2-HC-G341-GDS-ppan-MC-MMAF-LSWLLRLLN-Q342 | SEQ ID NO: 1183 | 65.0 | 76.9 | 56.0 | 81.0 | −9 | 4.2 | −4.7 |
| SEQ ID NO: 224 | anti-hHER2-HC-R344-GDS-ppan-MC-MMAF-LSWLLRLLN-E345 | SEQ ID NO: 1186 | 58.6 | 81.4 | 57.7 | 81.2 | −0.9 | −0.2 | −11.1 |
| SEQ ID NO: 229 | anti-hHER2-HC-K360-GDS-ppan-MC-MMAF-LSWLLRLLN-N361 | SEQ ID NO: 1187 | 70.1 | 81.7 | 68.8 | 81.4 | −1.3 | −0.3 | 0.4 |
| SEQ ID NO: 127 | anti-hHER2-HC-E388-GDS-ppan-MC-MMAF-LSWLLRLLN-N389 | SEQ ID NO: 1118 | 66.4 | 81.3 | 66.2 | 80.9 | −0.2 | −0.4 | −3.3 |
| SEQ ID NO: 239 | anti-hHER2-HC-Q418-GDS-ppan-MC-MMAF-LSWLLRLLN-Q419 | SEQ ID NO: 1195 | 69.0 | 81.0 | 68.3 | 81.1 | −0.7 | 0.1 | −0.7 |
| SEQ ID NO: 244 | anti-hHER2-HC-N434-GDS-ppan-MC-MMAF-LSWLLRLLN-H435 | SEQ ID NO: 1197 | 60.5 | 81.5 | n.d. | n.d. | n.d. | n.d. | −9.2 |
| SEQ ID NO: 248 | anti-hHER2-HC-P445-GDS-ppan-MC-MMAF-LSWLLRLLN-G446 | SEQ ID NO: 1199 | 71.8 | 81.0 | 69.9 | 80.5 | −1.8 | −0.5 | 2.1 |
| SEQ ID NO: 250 | anti-hHER2-HC-S119-DS-ppan-MC-MMAF-LEFIASKLA-T120 | SEQ ID NO: 1201 | 70.1 | t.b. | 71.2 | t.b. | 1 | t.b. | 0.4 |
| SEQ ID NO: 251 | anti-hHER2-HC-T120-DS-ppan-MC-MMAF-LEFIASKLA-K121 | SEQ ID NO: 1202 | 70.4 | t.b. | 70.4 | t.b. | 0 | t.b. | 0.7 |
| SEQ ID NO: 257 | anti-hHER2-HC-S136-DS-ppan-MC-MMAF-LEFIASKLA-137 | SEQ ID NO: 1203 | 69.3 | 80.8 | 68.3 | 81.0 | −1.1 | 0.2 | −0.4 |
| SEQ ID NO: 259 | anti-hHER2-HC-G138-DS-ppan-MC-MMAF-LEFIASKLA-T139 | SEQ ID NO: 1204 | 69.3 | 80.9 | 68.5 | 81.2 | −0.7 | 0.2 | −0.4 |
| SEQ ID NO: 268 | anti-hHER2-HC-S165-DS-ppan-MC-MMAF-LEFIASKLA-G166 | SEQ ID NO: 1209 | 69.6 | 80.3 | 69.2 | 80.5 | −0.4 | 0.1 | −0.1 |
| SEQ ID NO: 277 | anti-hHER2-HC-G194-DS-ppan-MC-MMAF-LEFIASKLA-T195 | SEQ ID NO: 1215 | 69.3 | 81.1 | 68.5 | 80.9 | −0.9 | −0.1 | −0.4 |
| SEQ ID NO: 315 | anti-hHER2-HC-L328-DS-ppan-MC-MMAF-LEFIASKLA-P329 | SEQ ID NO: 1243 | 56.9 | 78.8 | 50.4 | 81.0 | −6.5 | 2.1 | −12.8 |
| SEQ ID NO: 317 | anti-hHER2-HC-A330-DS-ppan-MC-MMAF-LEFIASKLA-P331 | SEQ ID NO: 1245 | 54.2 | 81.1 | 51.3 | 81.2 | −2.9 | 0.1 | −15.5 |
| SEQ ID NO: 129 | anti-hHER2-HC-E388-DS-ppan-MC-MMAF-LEFIASKLA-N389 | SEQ ID NO: 1122 | 69.3 | 81.5 | 68.8 | 81.0 | −0.6 | −0.5 | −0.4 |
| SEQ ID NO: 349 | anti-hHER2-HC-G446-DS-ppan-MC-MMAF-LEFIASKLA-K447 | SEQ ID NO: 1270 | 69.9 | 81.2 | 69.9 | 80.9 | 0 | −0.4 | 0.2 |
| SEQ ID NO: 32 | anti-hHER2-LC-V110-GDS-ppan-MC-MMAF-LSWLLRLLN-A111 | SEQ ID NO: 1272 | 66.9 | t.b. | 66.3 | t.b. | −0.6 | t.b. | −2.8 |
| SEQ ID NO: 33 | anti-hHER2-LC-A111-GDS-ppan-MC-MMAF-LSWLLRLLN-A112 | SEQ ID NO: 1273 | 67.3 | t.b. | 66.0 | t.b. | −1.3 | t.b. | −2.4 |
| SEQ ID NO: 46 | anti-hHER2-LC-Q155-GDS-ppan-MC-MMAF-LSWLLRLLN-S156 | SEQ ID NO: 1284 | 69.4 | 80.0 | 68.7 | 79.4 | −0.7 | −0.6 | −0.3 |

TABLE 23-continued

Thermal stability of modified antibodies and ADCs as determined by differential scanning fluorometry.

| Antibody SEQ ID: | ADC name[a] | ADC SEQ ID NO | Antibody Tm1 (° C.) | Antibody Tm2 (° C.) | ADC Tm1 (° C.) | ADC Tm2 (° C.) | ΔTm1[b] (° C.) | ΔTm2[b] (° C.) | Ab − WT ΔTm1[c] (° C.) |
|---|---|---|---|---|---|---|---|---|---|
| SEQ ID NO: 48 | anti-hHER2-LC-S162-GDS-ppan-MC-MMAF-LSWLLRLLN-V163 | SEQ ID NO: 1251 | 68.5 | t.b. | 67.3 | t.b. | −1.2 | t.b. | −1.2 |
| SEQ ID NO: 56 | anti-hHER2-LC-Q199-GDS-ppan-MC-MMAF-LSWLLRLLN-G200 | SEQ ID NO: 1292 | 67.5 | t.b. | 67.4 | t.b. | −0.1 | t.b. | −2.2 |
| SEQ ID NO: 63 | anti-hHER2-LC-V110-DS-ppan-MC-MMAF-LEFIASKLA-A111 | SEQ ID NO: 1294 | 69.0 | t.b. | 67.6 | t.b. | −1.4 | t.b. | −0.7 |
| SEQ ID NO: 64 | anti-hHER2-LC-A111-DS-ppan-MC-MMAF-LEFIASKLA-A112 | SEQ ID NO: 1295 | 69.6 | t.b. | 68.5 | t.b. | −1.1 | t.b. | −0.1 |
| SEQ ID NO: 75 | anti-hHER2-LC-A153-DS-ppan-MC-MMAF-LEFIASKLA-L154 | SEQ ID NO: 1305 | 69.6 | 79.7 | 69.0 | 79.2 | −0.5 | −0.5 | −0.1 |
| SEQ ID NO: 89 | anti-hHER2-LC-L201-DS-ppan-MC-MMAF-LEFIASKLA-S202 | SEQ ID NO: 1316 | 69.5 | 75.1 | 68.7 | 74.8 | −0.8 | −0.4 | −0.2 |

[a]Name represents part of the HC or LC that contains the peptide tag with the attached compound, the paired wildtype chain is not listed.
[b]Tm of ADC minus Tm of antibody.
[c]Tm1 of antibody minus Tm1 of wild-type trastuzumab (69.7° C.).
n.d., Not determined. Measurement was not performed due to insufficient sample amounts.
t.b., Transition too broad for accurate determination of Tm2.

Purified ADCs were further characterized for in vitro potency against selected cell lines (Table 24) including two engineered cell lines, MDA-MB231 clone 16 and clone 40, and two cell lines (JimT1 and HCC1954) that endogenously express the targeted antigen, human HER2, on the cell surface. MDA-MB231 clone 16 cells stably express ~500,000 copies of HER2 per cell while clone 40 expresses only ~5000 copies/cell. HCC1954 cells endogenously express high level (~500,000 copies/cell) of human HER2 on the surface (Clinchy B, Gazdar A, Rabinovsky R, Yefenof E, Gordon B, Vitetta E S. Breast Cancer Res Treat. (2000) 61:217-228). The JimT1 cell line expresses approximately 80,000 copies of HER2 per cell (Mocanu M-M, Fazekas Z, Petrás M, Nagy P, Sebestyén Z, Isola J, Timár J, Park J W, Vereb G, Szöllő si J. Cancer Letters (2005) 227: 201-212). The cell proliferation assays were conducted with Cell-Titer-Glo™ (Promega) five days after cells were incubated with various concentrations of ADCs (Riss et al., (2004) Assay Drug Dev Technol. 2:51-62) with an automated system (Melnick et al., (2006) Proc Natl Acad Sci USA. 103:3153-3158). Trastuzumab peptide-tagged-MMAF ADCs specifically killed MDA-MB231 clone 16, HCC1954 and JimT1 cells (Table 24) but not MDA-MB231 clone 40 cells. $IC_{50}$ values of the trastuzumab peptide-tagged-MMAF ADCs averaged around 0.24 pM, 0.9 nM and 2.9 nM for MDA-MB231 clone 16, HCC1954 and JimT1 cells, respectively (Table 24), consistent with the different HER2 expression levels.

TABLE 24

In vitro potency of anti-HER2 ADCs. $IC_{50}$ cell killing concentrations are reported for several HER2 positive cell lines.[b]

| Antibody SEQ ID | ADC name[a] | ADC SEQ ID NO | HCC1954 $IC_{50}$ (µM) | JimT1 $IC_{50}$ (µM) | MDA-MB-231 clone 16 $IC_{50}$ (µM) |
|---|---|---|---|---|---|
| SEQ ID NO: 151 | anti-hHER2-HC-S119-GDS-ppan-MC-MMAF-LSWLLRLLN-T120 | SEQ ID NO: 1137 | 1.94E−04 | 5.10E−04 | 6.82E−04 |
| SEQ ID NO: 152 | anti-hHER2-HC-T120-GDS-ppan-MC-MMAF-LSWLLRLLN-K121 | SEQ ID NO: 1138 | 1.69E−04 | 7.53E−04 | 7.02E−04 |
| SEQ ID NO: 157 | anti-hHER2-HC-T135-GDS-ppan-MC-MMAF-LSWLLRLLN-S136 | SEQ ID NO: 1139 | 1.36E−04 | 2.57E−04 | 3.10E−04 |
| SEQ ID NO: 158 | anti-hHER2-HC-S136-GDS-ppan-MC-MMAF-LSWLLRLLN-G137 | SEQ ID NO: 1140 | 1.64E−04 | 2.43E−04 | 3.05E−04 |
| SEQ ID NO: 166 | anti-hHER2-HC-A162-GDS-ppan-MC-MMAF-LSWLLRLLN-L163 | SEQ ID NO: 1147 | 1.55E−04 | 8.66E−04 | 3.31E−04 |
| SEQ ID NO: 168 | anti-hHER2-HC-T164-GDS-ppan-MC-MMAF-LSWLLRLLN-S165 | SEQ ID NO: 1148 | 1.89E−04 | 5.36E−04 | 4.69E−04 |

TABLE 24-continued

In vitro potency of anti-HER2 ADCs. $IC_{50}$ cell killing concentrations are reported for several HER2 positive cell lines.[b]

| Antibody SEQ ID | ADC name[a] | ADC SEQ ID NO | HCC1954 $IC_{50}$ (μM) | JimT1 $IC_{50}$ (μM) | MDA-MB-231 clone 16 $IC_{50}$ (μM) |
|---|---|---|---|---|---|
| SEQ ID NO: 169 | anti-hHER2-HC-S165-GDS-ppan-MC-MMAF-LSWLLRLLN-G166 | SEQ ID NO: 1149 | 1.69E−04 | 6.19E−04 | 4.00E−04 |
| SEQ ID NO: 173 | anti-hHER2-HC-P189-GDS-ppan-MC-MMAF-LSWLLRLLN-S190 | SEQ ID NO: 1152 | 1.47E−04 | 2.69E−04 | 2.86E−04 |
| SEQ ID NO: 178 | anti-hHER2-HC-G194-GDS-ppan-MC-MMAF-LSWLLRLLN-T195 | SEQ ID NO: 1156 | 1.03E−04 | 1.33E−03 | 3.56E−04 |
| SEQ ID NO: 179 | anti-hHER2-HC-T195-GDS-ppan-MC-MMAF-LSWLLRLLN-Q196 | SEQ ID NO: 1157 | 1.42E−04 | 3.00E−04 | 2.79E−04 |
| SEQ ID NO: 202 | anti-hHER2-HC-P271-GDS-ppan-MC-MMAF-LSWLLRLLN-E272 | SEQ ID NO: 1172 | 1.33E−04 | 4.50E−04 | 6.75E−04 |
| SEQ ID NO: 218 | anti-hHER2-HC-A330-GDS-ppan-MC-MMAF-LSWLLRLLN-P331 | SEQ ID NO: 1181 | 9.68E−05 | 3.18E−04 | 4.66E−04 |
| SEQ ID NO: 220 | anti-hHER2-HC-K340-GDS-ppan-MC-MMAF-LSWLLRLLN-G341 | SEQ ID NO: 1182 | 3.76E−04 | 5.55E−04 | 3.08E−04 |
| SEQ ID NO: 221 | anti-hHER2-HC-G341-GDS-ppan-MC-MMAF-LSWLLRLLN-Q342 | SEQ ID NO: 1183 | 7.21E−05 | 3.58E−04 | 7.82E−04 |
| SEQ ID NO: 224 | anti-hHER2-HC-R344-GDS-ppan-MC-MMAF-LSWLLRLLN-E345 | SEQ ID NO: 1186 | 2.13E−03 | 4.47E−04 | 3.21E−04 |
| SEQ ID NO: 229 | anti-hHER2-HC-K360-GDS-ppan-MC-MMAF-LSWLLRLLN-N361 | SEQ ID NO: 1187 | 1.80E−04 | 1.31E−03 | 7.57E−04 |
| SEQ ID NO: 127 | anti-hHER2-HC-E388-GDS-ppan-MC-MMAF-LSWLLRLLN-N389 | SEQ ID NO: 1118 | 1.57E−04 | 4.21E−04 | 5.42E−04 |
| SEQ ID NO: 239 | anti-hHER2-HC-Q418-GDS-ppan-MC-MMAF-LSWLLRLLN-Q419 | SEQ ID NO: 1195 | 2.48E−04 | 1.24E−03 | 7.31E−04 |
| SEQ ID NO: 244 | anti-hHER2-HC-N434-GDS-ppan-MC-MMAF-LSWLLRLLN-H435 | SEQ ID NO: 1197 | n.d. | n.d. | n.d. |
| SEQ ID NO: 248 | anti-hHER2-HC-P445-GDS-ppan-MC-MMAF-LSWLLRLLN-G446 | SEQ ID NO: 1199 | 7.42E−05 | 3.84E−03 | 7.44E−04 |
| SEQ ID NO: 250 | anti-hHER2-HC-S119-DS-ppan-MC-MMAF-LEFIASKLA-T120 | SEQ ID NO: 1201 | 1.80E−04 | 3.46E−04 | 3.21E−04 |
| SEQ ID NO: 251 | anti-hHER2-HC-T120-DS-ppan-MC-MMAF-LEFIASKLA-K121 | SEQ ID NO: 1202 | 1.98E−04 | 4.59E−04 | 3.94E−04 |
| SEQ ID NO: 257 | anti-hHER2-HC-S136-DS-ppan-MC-MMAF-LEFIASKLA-137 | SEQ ID NO: 1203 | 6.48E−05 | 3.95E−04 | 2.62E−04 |
| SEQ ID NO: 259 | anti-hHER2-HC-G138-DS-ppan-MC-MMAF-LEFIASKLA-T139 | SEQ ID NO: 1204 | 1.58E−04 | 3.33E−02 | 3.21E−04 |
| SEQ ID NO: 268 | anti-hHER2-HC-S165-DS-ppan-MC-MMAF-LEFIASKLA-G166 | SEQ ID NO: 1209 | 1.65E−04 | 4.07E−04 | 3.79E−04 |
| SEQ ID NO: 277 | anti-hHER2-HC-G194-DS-ppan-MC-MMAF-LEFIASKLA-T195 | SEQ ID NO: 1215 | 1.22E−04 | 6.48E−04 | 1.83E−04 |
| SEQ ID NO: 315 | anti-hHER2-HC-L328-DS-ppan-MC-MMAF-LEFIASKLA-P329 | SEQ ID NO: 1243 | 1.37E−04 | 2.79E−04 | 1.15E−03 |
| SEQ ID NO: 317 | anti-hHER2-HC-A330-DS-ppan-MC-MMAF-LEFIASKLA-P331 | SEQ ID NO: 1245 | 4.09E−04 | 2.24E−02 | 2.85E−04 |
| SEQ ID NO: 129 | anti-hHER2-HC-E388-DS-ppan-MC-MMAF-LEFIASKLA-N389 | SEQ ID NO: 1122 | 2.26E−04 | 1.83E−03 | 3.12E−04 |
| SEQ ID NO: 349 | anti-hHER2-HC-G446-DS-ppan-MC-MMAF-LEFIASKLA-K447 | SEQ ID NO: 1270 | 2.12E−04 | 6.82E−04 | 7.77E−04 |

TABLE 24-continued

In vitro potency of anti-HER2 ADCs. $IC_{50}$ cell killing concentrations are reported for several HER2 positive cell lines.[b]

| Antibody SEQ ID | ADC name[a] | ADC SEQ ID NO | HCC1954 $IC_{50}$ (μM) | JimT1 $IC_{50}$ (μM) | MDA-MB-231 clone 16 $IC_{50}$ (μM) |
|---|---|---|---|---|---|
| SEQ ID NO: 32 | anti-hHER2-LC-V110-GDS-ppan-MC-MMAF-LSWLLRLLN-A111 | SEQ ID NO: 1272 | 2.31E−04 | 4.14E−04 | 5.18E−04 |
| SEQ ID NO: 33 | anti-hHER2-LC-A111-GDS-ppan-MC-MMAF-LSWLLRLLN-A112 | SEQ ID NO: 1273 | 1.95E−04 | 1.15E−02 | 5.05E−04 |
| SEQ ID NO: 46 | anti-hHER2-LC-Q155-GDS-ppan-MC-MMAF-LSWLLRLLN-S156 | SEQ ID NO: 1284 | 1.43E−04 | 5.47E−04 | 3.70E−04 |
| SEQ ID NO: 48 | anti-hHER2-LC-S162-GDS-ppan-MC-MMAF-LSWLLRLLN-V163 | SEQ ID NO: 1251 | 2.67E−04 | 8.13E−04 | 7.14E−04 |
| SEQ ID NO: 56 | anti-hHER2-LC-Q199-GDS-ppan-MC-MMAF-LSWLLRLLN-G200 | SEQ ID NO: 1292 | 1.92E−04 | 9.21E−04 | 4.77E−04 |
| SEQ ID NO: 63 | anti-hHER2-LC-V110-DS-ppan-MC-MMAF-LEFIASKLA-A111 | SEQ ID NO: 1294 | 3.97E−04 | 4.62E−04 | 2.77E−04 |
| SEQ ID NO: 64 | anti-hHER2-LC-A111-DS-ppan-MC-MMAF-LEFIASKLA-A112 | SEQ ID NO: 1295 | 1.59E−04 | 6.32E−04 | 1.68E−02 |
| SEQ ID NO: 75 | anti-hHER2-LC-A153-DS-ppan-MC-MMAF-LEFIASKLA-L154 | SEQ ID NO: 1305 | 1.80E−04 | 2.03E−02 | 2.60E−04 |
| SEQ ID NO: 89 | anti-hHER2-LC-L201-DS-ppan-MC-MMAF-LEFIASKLA-S202 | SEQ ID NO: 1316 | 4.25E−04 | 3.86E−04 | 4.74E−04 |

[a]Name represents part of the HC or LC that contains the peptide tag with the attached compound, the paired wildtype chain is not listed.
[b]No cell killing was observed for HER2 negative cells at the highest concentration measured (33 nM).
n.d., not determined.

Good pharmacokinetic properties are essential for in vivo efficacy of ADCs (Hamblett, et al., *Clin Cancer Res.*, 10:7063-7070 (2004); Alley et al., *Bioconjug. Chem.* 19:759-765 (2008)). The conjugation of a CoA-MC-MMAF molecule to an antibody can negatively affect its biophysical properties resulting in rapid clearance and dramatically reduced in vivo efficacy of the corresponding ADC (Hamblett et al., 2004). To evaluate the effects of conjugation site on in vivo clearance and ADC in vivo stability, pharmacokinetic (PK) studies were performed in non-tumor bearing mice with all 39 peptide-tagged trastuzumab ADCs (Table 25).

Each peptide-tagged MMAF ADC was injected intravenously into three mice at a single dose of 1 mg/kg. Nine plasma samples were then collected over a time course of 340 hours before plasma titers of the ADCs were determined by ELISA. The ELISA assay uses the immobilized extracellular domain of human HER2 for capturing trastuzumab ADC molecules from plasma samples. Following the capture step of this assay, an anti-MMAF antibody is used to exclusively measure the plasma concentration of the "intact" trastuzumab MMAF conjugate. In a second ELISA experiment, an anti-hIgG antibody generates a signal indicating the plasma concentration of both conjugated and unconjugated trastuzumab molecules. If no payload deconjugation of the ADC occurs in vivo, both anti-MMAF and anti-hIgG ELISAs are expected to provide identical readouts on ADC plasma concentration. However, in the case of payload loss in vivo, the anti-MMAF ELISA is expected to produce a lower signal than the anti-hIgG ELISA. The comparison of both ELISA signals therefore allows the quantification of payload deconjugation during the in vivo exposure of the respective ADC. The interpretation of the PK data is based on standard curves that were generated with the same ADCs as used for intravenous injection into mice.

Figure 19:
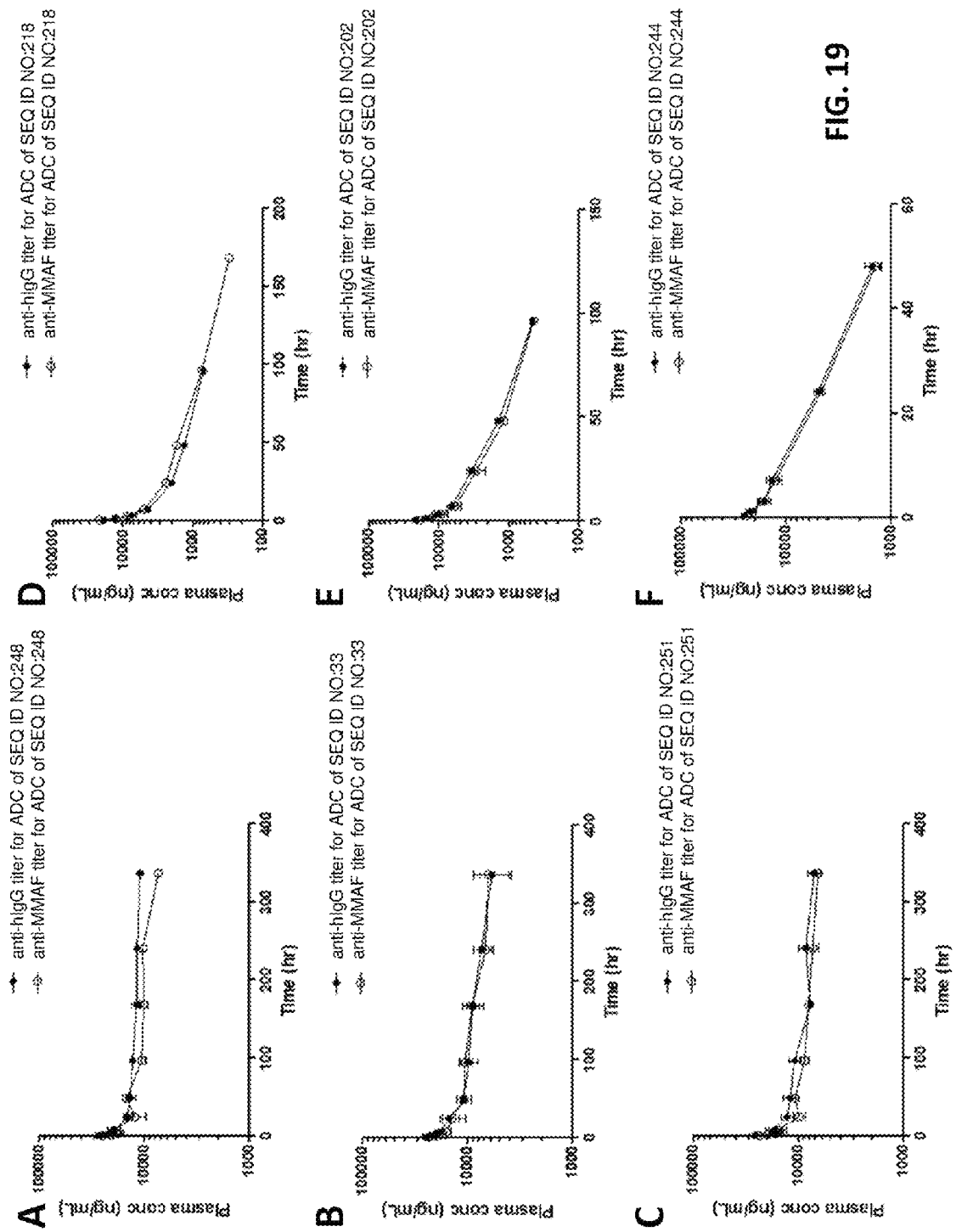
FIG. 19. Pharmacokinetic profiles of peptide-tagged trastuzumab immunoconjugates displaying high and low AUC IgG values. Each of the six peptide-tagged ADCs corresponding to SEQ ID NO:248 (A), SEQ ID NO:33 (B), SEQ ID NO:251 (C), SEQ ID NO:218 (D), SEQ ID NO:202 (E), and SEQ ID NO:244 (F) was administered intravenously into three mice at a single dose of 1 mg/kg. After collection of plasma samples over a time period of 340 hours, trastuzumab ADC molecules were captured by using the immobilized extracellular domain of human HER2. Plasma titers were then determined by two ELISA formats based on either anti-MMAF or anti-hIgG antibodies. While the first format provides readout on the concentration of "intact" ADC, the latter format generates a signal proportional to the concentration of total IgG, comprising both conjugated and unconjugated trastuzumab molecules. A-C exemplify PK curves of peptide-tagged MMAF ADCs displaying high AUC IgG values, whereas D-F show examples of immunoconjugates exhibiting very low AUC IgG values. In all cases, anti-MMAF and anti-hIgG titers closely parallel each other indicating negligible deconjugation of the MMAF payload during the time course of the PK study.

The area-under-the-plasma-concentration-versus-time-curve (AUC) is an important pharmacokinetic parameter that can be used to determine the total clearance and bioavailability of the administered biotherapeutic agent. For each peptide-tagged MMAF ADC, two characteristic AUC values, AUC hIgG and AUC MMAF, were obtained by the anti-hIgG and anti-MMAF ELISA experiments, respectively. Table 25 summarizes the AUC hIgG and AUC MMAF values as well as their respective ratios of the 39 tested peptide-tagged ADCs. The obtained AUC hIgG values span over a wide range with the highest value of 28334 nM*hr being about 20-fold higher than the lowest value of 1362 nM*hr, with the average being 16275 nM*hr. FIG. 19A-C exemplifies PK curves of three peptide-tagged MMAF ADCs displaying high AUC hIgG values (ADC of SEQ ID NO:248, 28334 nM*hr; ADC of SEQ ID NO:33, 21011 nM*hr; ADC of SEQ ID NO:251, 21689 nM*hr). On the contrary, PK curves of three constructs showing low AUC hIgG values (ADC of SEQ ID NO:218, 1362 nM*hr; ADC of SEQ ID NO:202, 1757 nM*hr; ADC of SEQ ID NO:244, 2378 nM*hr) are illustrated in FIG. 19D-F. Despite the great variation of AUC hIgG values, both anti-hIgG and anti-MMAF titers track each other, suggesting that little if any payload deconjugation occurred in vivo. Moreover, the ratios between AUC MMAF and AUC hIgG values of all 39 tested peptide-tagged ADCs average at 1.0±0.1 (AUC (MMAF)/AUC(hIgG), see Table 25) suggesting that the maleimide-based linkage between the MC-MMAF and the terminal thiol of the 4'-phosphopantetheine (ppan) moiety remained stable in circulation over the time course of the PK experiment. Likewise, these results also indicate a high in vivo stability of the phosphodiester-based linkage between the ppan prosthetic group and the serine residue of the inserted S6/ybbR peptide tag.

The rapid clearance observed for some of the peptide-tagged ADCs may be attributed to the insertion of an S6 or ybbR peptide sequence into specific regions of the IgG1 molecule. This putative relationship between tag insertion site and pharmacokinetic profile is exemplified by the two peptide-tagged MMAF ADCs of SEQ ID NO:218 and SEQ ID NO:202, which display the lowest AUC hIgG values of 1362 nM*hr and 1757 nM*hr, respectively. Both ADCs contain S6 tag insertions in the CH2 domain of the heavy chain. In addition to the instability in murine circulation, these ADCs also exhibit the lowest and third lowest thermostabilities of the 39 tested samples of the PK study. According to DSF measurements, the corresponding ADCs display Tm1s of 49.0° C. (ADC of SEQ ID NO:218) and 51.2° C. (ADC of SEQ ID NO:202), resulting in a decrease of 20.7° C. and 18.5° C., respectively, in comparison to wild-type trastuzumab having a Tm1 of 69.7° C. In contrast, the 16 ADCs with the highest AUC hIgG values (18406-28334 nM*hr) display Tm1 values which are not more than 3.7° C. below the Tm1 of wild-type trastuzumab, suggesting a possible correlation between pharmacokinetics and thermostability of ADCs. Moreover, ten of these 16 ADCs contain S6 or ybbR tags in loop regions of the CH1 domain of the heavy chain. As mentioned above, peptide tag insertions at these favorable sites also display the best overall conjugation efficiencies, making them preferred candidates for ADC production. These include antibodies with heavy chain insertions between S119-T120, T120-K121, T135-S136, S136-G137, G138-T139, S165-G166, and E388-N389 (CH3 domain) corresponding to SEQ ID numbers 151, 250, 152, 251, 157, 256, 158, 257, 160, 259, 169, 268, 126, 127, 128, 129, 130, 131, 132, 149, and 356.

TABLE 25

Pharmacokinetics data.

| Antibody SEQ ID | ADC name[a] | ADC SEQ ID NO | AUC[b] hIgG (nM * hr) | AUC[c] MMAF (nM * hr) | AUC (MMAF)/ AUC (hIgG) |
|---|---|---|---|---|---|
| SEQ ID NO: 151 | anti-hHER2-HC-S119-GDS-ppan-MC-MMAF-LSWLLRLLN-T120 | SEQ ID NO: 1137 | 22485 | 21693 | 1.0 |
| SEQ ID NO: 152 | anti-hHER2-HC-T120-GDS-ppan-MC-MMAF-LSWLLRLLN-K121 | SEQ ID NO: 1138 | 13880 | 12542 | 0.9 |
| SEQ ID NO: 157 | anti-hHER2-HC-T135-GDS-ppan-MC-MMAF-LSWLLRLLN-S136 | SEQ ID NO: 1139 | 21494 | 16931 | 0.8 |
| SEQ ID NO: 158 | anti-hHER2-HC-S136-GDS-ppan-MC-MMAF-LSWLLRLLN-G137 | SEQ ID NO: 1140 | 22833 | 23533 | 1.0 |
| SEQ ID NO: 166 | anti-hHER2-HC-A162-GDS-ppan-MC-MMAF-LSWLLRLLN-L163 | SEQ ID NO: 1147 | 11178 | 10981 | 1.0 |
| SEQ ID NO: 168 | anti-hHER2-HC-T164-GDS-ppan-MC-MMAF-LSWLLRLLN-S165 | SEQ ID NO: 1148 | 20916 | 22125 | 1.1 |
| SEQ ID NO: 169 | anti-hHER2-HC-S165-GDS-ppan-MC-MMAF-LSWLLRLLN-G166 | SEQ ID NO: 1149 | 23242 | 21304 | 0.9 |
| SEQ ID NO: 173 | anti-hHER2-HC-P189-GDS-ppan-MC-MMAF-LSWLLRLLN-S190 | SEQ ID NO: 1152 | 8922 | 8840 | 1.0 |
| SEQ ID NO: 178 | anti-hHER2-HC-G194-GDS-ppan-MC-MMAF-LSWLLRLLN-T195 | SEQ ID NO: 1156 | 20702 | 18593 | 0.9 |
| SEQ ID NO: 179 | anti-hHER2-HC-T195-GDS-ppan-MC-MMAF-LSWLLRLLN-Q196 | SEQ ID NO: 1157 | 16083 | 17465 | 1.1 |
| SEQ ID NO: 202 | anti-hHER2-HC-P271-GDS-ppan-MC-MMAF-LSWLLRLLN-E272 | SEQ ID NO: 1172 | 1757 | 1550 | 0.9 |
| SEQ ID NO: 218 | anti-hHER2-HC-A330-GDS-ppan-MC-MMAF-LSWLLRLLN-P331 | SEQ ID NO: 1181 | 1362 | 1768 | 1.3 |
| SEQ ID NO: 220 | anti-hHER2-HC-K340-GDS-ppan-MC-MMAF-LSWLLRLLN-G341 | SEQ ID NO: 1182 | 17396 | 16060 | 0.9 |
| SEQ ID NO: 221 | anti-hHER2-HC-G341-GDS-ppan-MC-MMAF-LSWLLRLLN-Q342 | SEQ ID NO: 1183 | 9214 | 10336 | 1.1 |
| SEQ ID NO: 224 | anti-hHER2-HC-R344-GDS-ppan-MC-MMAF-LSWLLRLLN-E345 | SEQ ID NO: 1186 | 15196 | 16061 | 1.1 |
| SEQ ID NO: 229 | anti-hHER2-HC-K360-GDS-ppan-MC-MMAF-LSWLLRLLN-N361 | SEQ ID NO: 1187 | 7867 | 8209 | 1.0 |

TABLE 25-continued

Pharmacokinetics data.

| Antibody SEQ ID | ADC name[a] | ADC SEQ ID NO | AUC[b] hIgG (nM * hr) | AUC[c] MMAF (nM * hr) | AUC (MMAF)/ AUC (hIgG) |
|---|---|---|---|---|---|
| SEQ ID NO: 127 | anti-hHER2-HC-E388-GDS-ppan-MC-MMAF-LSWLLRLLN-N389 | SEQ ID NO: 1118 | 14224 | 14887 | 1.0 |
| SEQ ID NO: 239 | anti-hHER2-HC-Q418-GDS-ppan-MC-MMAF-LSWLLRLLN-Q419 | SEQ ID NO: 1195 | 8561 | 6136 | 0.7 |
| SEQ ID NO: 244 | anti-hHER2-HC-N434-GDS-ppan-MC-MMAF-LSWLLRLLN-H435 | SEQ ID NO: 1197 | 2378 | 2249 | 0.9 |
| SEQ ID NO: 248 | anti-hHER2-HC-P445-GDS-ppan-MC-MMAF-LSWLLRLLN-G446 | SEQ ID NO: 1199 | 28334 | 24130 | 0.9 |
| SEQ ID NO: 250 | anti-hHER2-HC-S119-DS-ppan-MC-MMAF-LEFIASKLA-T120 | SEQ ID NO: 1201 | 22854 | 24551 | 1.1 |
| SEQ ID NO: 251 | anti-hHER2-HC-T120-DS-ppan-MC-MMAF-LEFIASKLA-K121 | SEQ ID NO: 1202 | 21689 | 19734 | 0.9 |
| SEQ ID NO: 257 | anti-hHER2-HC-S136-DS-ppan-MC-MMAF-LEFIASKLA-137 | SEQ ID NO: 1203 | 27232 | 24064 | 0.9 |
| SEQ ID NO: 259 | anti-hHER2-HC-G138-DS-ppan-MC-MMAF-LEFIASKLA-T139 | SEQ ID NO: 1204 | 17184 | 15404 | 0.9 |
| SEQ ID NO: 268 | anti-hHER2-HC-S165-DS-ppan-MC-MMAF-LEFIASKLA-G166 | SEQ ID NO: 1209 | 12794 | 13854 | 1.1 |
| SEQ ID NO: 277 | anti-hHER2-HC-G194-DS-ppan-MC-MMAF-LEFIASKLA-T195 | SEQ ID NO: 1215 | 20659 | 21603 | 1.0 |
| SEQ ID NO: 315 | anti-hHER2-HC-L328-DS-ppan-MC-MMAF-LEFIASKLA-P329 | SEQ ID NO: 1243 | 7590 | 8039 | 1.1 |
| SEQ ID NO: 317 | anti-hHER2-HC-A330-DS-ppan-MC-MMAF-LEFIASKLA-P331 | SEQ ID NO: 1245 | 12960 | 14302 | 1.1 |
| SEQ ID NO: 129 | anti-hHER2-HC-E388-DS-ppan-MC-MMAF-LEFIASKLA-N389 | SEQ ID NO: 1122 | 21023 | 21257 | 1.0 |
| SEQ ID NO: 349 | anti-hHER2-HC-G446-DS-ppan-MC-MMAF-LEFIASKLA-K447 | SEQ ID NO: 1270 | 20329 | 16452 | 0.8 |
| SEQ ID NO: 32 | anti-hHER2-LC-V110-GDS-ppan-MC-MMAF-LSWLLRLLN-A111 | SEQ ID NO: 1272 | 17358 | 18734 | 1.1 |
| SEQ ID NO: 33 | anti-hHER2-LC-A111-GDS-ppan-MC-MMAF-LSWLLRLLN-A112 | SEQ ID NO: 1273 | 21011 | 20711 | 1.0 |
| SEQ ID NO: 46 | anti-hHER2-LC-Q155-GDS-ppan-MC-MMAF-LSWLLRLLN-S156 | SEQ ID NO: 1284 | 15444 | 17657 | 1.1 |
| SEQ ID NO: 48 | anti-hHER2-LC-S162-GDS-ppan-MC-MMAF-LSWLLRLLN-V163 | SEQ ID NO: 1251 | 11348 | 11645 | 1.0 |
| SEQ ID NO: 56 | anti-hHER2-LC-Q199-GDS-ppan-MC-MMAF-LSWLLRLLN-G200 | SEQ ID NO: 1292 | 16832 | 17973 | 1.1 |
| SEQ ID NO: 63 | anti-hHER2-LC-V110-DS-ppan-MC-MMAF-LEFIASKLA-A111 | SEQ ID NO: 1294 | 20373 | 24757 | 1.2 |
| SEQ ID NO: 64 | anti-hHER2-LC-A111-DS-ppan-MC-MMAF-LEFIASKLA-A112 | SEQ ID NO: 1295 | 16092 | 16196 | 1.0 |
| SEQ ID NO: 75 | anti-hHER2-LC-A153-DS-ppan-MC-MMAF-LEFIASKLA-L154 | SEQ ID NO: 1305 | 18406 | 19496 | 1.1 |
| SEQ ID NO: 89 | anti-hHER2-LC-L201-DS-ppan-MC-MMAF-LEFIASKLA-S202 | SEQ ID NO: 1316 | 17223 | 15036 | 0.9 |

[a]Name represents part of the HC or LC that contains the peptide tag with the attached compound, the paired wildtype chain is not listed.
[b]Area-under-the-curve measured by anti-human IgG ELISA.
[c]Area-under-the-curve measured by anti-MMAF ELISA.

Example 26

Labeling of Peptide-Tagged IgGs with a Co-Expressed 4'-Phospho-Pantetheinyl Transferase in Culture Medium In order to streamline the process of preparing ADCs, enzymatic labeling of peptide-tagged antibodies with co-expressed 4'-phosphopantetheinyl transferase (PPTase) was carried out in Freestyle™ expression media (Invitrogen). In addition to reducing the number of purification steps, co-expression of the PPTase during antibody production could circumvent problems associated with the addition and the removal of a recombinantly produced version of such an enzyme. As a proof-of-concept, AcpS PPTase from E. coli was used to site-specifically conjugate an A1-tagged antibody with acetyl coenzyme A (acetyl CoA) in culture medium.

To facilitate co-expression, the gene encoding the AcpS PPTase was cloned into the mammalian expression vector pRS, which appends the N-terminal signal sequence MKT-FILLLWVLLLWVIFLLPGATA (SEQ ID NO: 355). The construct, pRS-AcpS, also adds a C-terminal $His_6$ tag (SEQ ID NO: 1106) to the recombinant enzyme. To co-express the A1-tagged antibody mAb2-HC-E388-GDSLDMLEWSLM-N389 (SEQ ID NO:356), an oligonucleotide fragment encoding the 12-amino-acid A1 peptide sequence was inserted into the heavy chain gene of the antibody mAb2-HC (SEQ ID NO: 147) in the mammalian expression vector pM4, resulting in the construct pM4-A1. This plasmid also co-expresses the corresponding light chain under the CMV promoter. Using the PEI method (Meissner et al., 2001), 293 Freestyle™ cells were transiently transfected with a 1:1 mixture of the recombinant expression plasmids pM4-A1 and pRS-AcpS, and cultured in 50 mL of Freestyle™ expression media (Invitrogen) for five days at 37° C. under 5% $CO_2$. Next, the cell culture was harvested by centrifugation at 3,000 rpm for 10 min and passed through a 0.22 μm filter. To mimic the higher concentrations that can be expected with production cell lines, the filtrate was concentrated about 30-fold using a 30 kDa cut-off Amicon Ultra centrifugal filter unit (EMD Millipore). After removing precipitate by centrifugation at 20,800×g for 1 min, 900 μL of the concentrate was supplemented with 100 of 10-fold reaction buffer (pH 8.8) containing 750 mM of Tris-HCl and 100 mM of $MgCl_2$. The labeling reaction was then initiated by adding 20 μL of 25 mM acetyl CoA (Sigma-Aldrich) to 480 μL of the concentrate, yielding a final concentration of 1 mM of acetyl CoA substrate (Exp. #1). To test whether labeling of the A1-tagged antibody can occur in the absence of exogenously added acetyl CoA substrate, the remaining 500 μL of the concentrate were left untreated (Exp. #2). The two reaction mixtures were incubated for approximately 16 h at 37° C.

To determine the degree of labeling of the A1-tagged antibody as well as to quantify expression levels of both enzyme and antibody, the reaction mixtures were purified by Protein A and Ni-NTA affinity chromatography. Each reaction was diluted two-fold with PBS, and applied to Protein A-Sepharose columns (0.5 mL bed volume, GE Healthcare) at an approximate flowrate of 1 mL/min. The column flowthrough was directly applied to PBS-equilibrated IMAC columns filled with 0.5 mL of Ni-NTA Agarose (Qiagen). Protein A and Ni-NTA affinity columns were washed with 20 column volumes of 50 mM of Tris-HCl buffer (pH 8) supplemented with 300 mM of NaCl and 20 mM of imidazole. $His_6$-tagged AcpS enzyme ("$His_6$" disclosed as SEQ ID NO: 1106) was eluted from the Ni-NTA affinity columns with 5 column volumes of 50 mM of Tris-HCl buffer (pH 8) containing 300 mM of NaCl and 250 mM of imidazole. Likewise, the A1-tagged antibody was eluted from the Protein A affinity columns with 5 column volumes of 0.1 M sodium acetate buffer (pH 3.0) followed by immediate neutralization with 1 M of Tris-HCl buffer (pH 10).

SDS-PAGE and ESI-MS confirmed elution of A1-tagged antibody and AcpS enzyme, respectively. UV-Vis and Bradford measurements indicated that approximately 0.3 to 0.4 mg of A1-tagged antibody and 0.08 to 0.2 mg of AcpS enzyme were recovered (Table 26). This suggests an antibody concentration of approximately 4-5 μM (0.6-0.8 mg/mL) during the labeling reactions in cell culture medium.

TABLE 26

Expression yields of mAb2-HC-E388-GDSLDMLEWSLM-N389 (SEQ ID NO: 356) and AcpS PPTase as well as mass spectrometric evaluation of enzymatic labeling in cell culture medium.

| Exp. | Yield of AcpS PPTase (mg) | Yield of mAb2-HC-E388-GDSLDMLEWSLM-N389 (SEQ ID NO: 356) (mg) | Observed mass (Da) | Expected mass (Da)[a] |
|---|---|---|---|---|
| Exp. #1 | 0.08 | 0.3 | 51926.79 | Uncoupled, 51589.2 Coupled, 51971.6 |
| Exp. #2 | 0.2 | 0.4 | 51586.41 | Coupled and deacetylated, 51929.6 |

[a]Expected masses are shown for pyroglutamic acid formation of the N-terminal glutamine residue of the heavy chain after signal peptide cleavage.

The antibody sample of Exp. #1 was reduced and deglycosylated followed by mass spectrometric analysis on an Agilent 6520 Q-TOF instrument (Agilent Technologies). The corresponding sample of Exp. #2 served as a control in order to rule out potential "in-medium" labeling of the A1-tagged antibody via an endogenous source of CoA or an analog thereof. As shown in Table 26, quantitative conjugation of the A1-tagged antibody was observed in the presence of 1 mM of acetyl CoA substrate (Exp. #1). In contrast, no detectable formation of the antibody conjugate was found when acetyl CoA was omitted (Exp. #2), thereby excluding the presence of significant amounts of CoA or one of its analogs in the cell-culture medium. Notably, the antibody conjugate of Exp. #1 completely lacks the acetyl group of the acetyl CoA substrate which indicates hydrolysis of the thioester bond by nucleophilic components in the conditioned cell-culture medium. The formation of a free thiol group after deacetylation in cell-culture medium could enable a two-step preparation of peptide-tagged ADCs. Following Protein A purification, the antibody with the in situ generated free thiol group could be reacted with a maleimide-toxin conjugate to afford the corresponding ADC in the second step. In summary, the experiment demonstrates that a peptide-tagged antibody can be quantitatively labeled with a supplemented CoA analog in 30-fold concentrated cell-culture medium via PPTase catalysis.

Example 27

In Vivo Efficacy Assessment of a ybbR-Tagged Trastuzumab MMAF ADC

Figure 20:
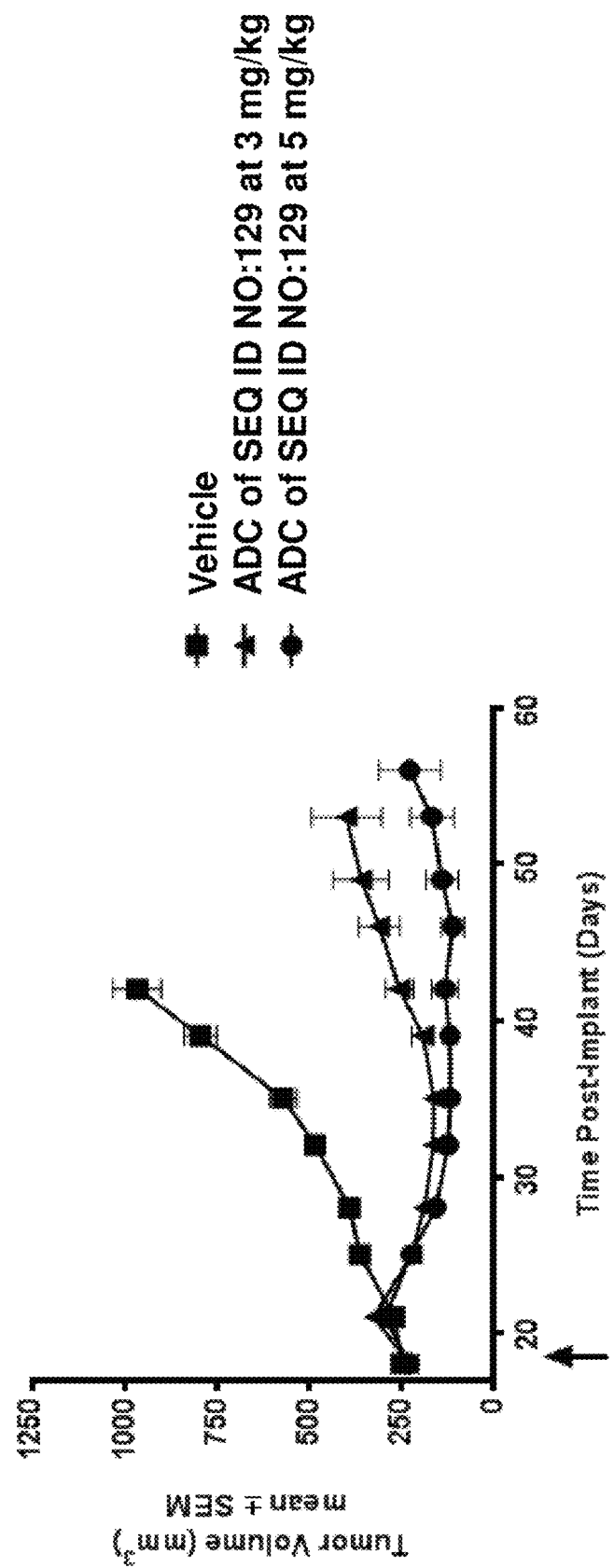
FIG. 20. In vivo efficacy study of the ybbR-tagged trastuzumab ADC anti-hHER2-HC-E388-DS-ppan-MC-MMAF-LEFIASKLA-N389 (SEQ ID NO:1122) in immune-deficient nude mice implanted with a human tumor cell line. The xenograft tumor model was performed with nu/nu mice which were subcutaneously administered with the HER2-dependent breast cancer cell line MDA-MB231 clone 16. After the tumor has grown to a size of about 200 mm³, single doses of 3 mg/kg (▲), 5 mg/kg (●) of the ybbR-tagged ADC or vehicle alone (■) were intravenously injected into nine mice per treatment group. The vertical arrow indicates the time point of ADC administration. Weekly monitoring of tumor growth revealed that both dose levels resulted in tumor regression demonstrating in vivo efficacy of the peptide-tagged ADC.

The in vivo efficacy of the ybbR-tagged trastuzumab ADC anti-hHER2-HC-E388-DS-ppan-MC-MMAF-LE-FIASKLA-N389 (SEQ ID NO:1122) was assessed by using a xenograft tumor model, which is based on the implantation of a human tumor cell line into immune-deficient nude mice. As described previously (Sausville and Burger, 2006), studies with such tumor xenograft mice have provided valuable insights into the in vivo efficacy of anti-cancer reagents. Specifically, the in vivo efficacy study was carried out with nu/nu mice that were subcutaneously injected with MDA-MB231 clone 16 cells (Morton and Houghton, 2007). This cell line was chosen based on previous in vitro potency assays revealing its high sensitivity to the aforementioned ybbR-tagged MMAF ADC in an antigen dependent manner (see Table 24). After the tumor reached a size of about 200 mm$^3$, the ybbR-tagged MMAF ADC was intravenously injected in a single dose at either 5 mg/kg or 3 mg/kg, with each treatment group comprising nine mice. After administering the antibody-drug conjugate, the tumor growth was monitored weekly. As shown in FIG. 20, i.v. administration of the ybbR-tagged MMAF ADC caused tumor regression at both dose levels. Furthermore, the treatment of the mice with the ADC was well tolerated with no weight loss observed in any of the treatment groups. The effective regression of MDA-MB231 clone 16 tumors at single doses as low as 3 mg/kg demonstrates that the ybbR-tagged ADC is efficacious in a HER2-dependent tumor mouse model. All animal studies were conducted in accordance with the Guide for the Care and Use of Laboratory Animals (NIH publication; National Academy Press, 8$^{th}$ edition, 2001).

SEQUENCE LISTING (1336 sequences)

SEQ ID NO: 1 - protein, 12 aa, Artificial Sequence
  Description of Artificial Sequence: Synthetic peptide
GDSLSWLLRLLN

SEQ ID NO: 2 - protein, 7 aa, Artificial Sequence
  Description of Artificial Sequence: Synthetic peptide
GDSLSWL

SEQ ID NO: 3 - protein, 12 aa, Artificial Sequence
  Description of Artificial Sequence: Synthetic peptide
GDSLSWLVRCLN

SEQ ID NO: 4 - protein, 12 aa, Artificial Sequence
  Description of Artificial Sequence: Synthetic peptide
GDSLSWLLRCLN

SEQ ID NO: 5 - protein, 12 aa, Artificial Sequence
  Description of Artificial Sequence: Synthetic peptide
GDSLSWLVRLLN

SEQ ID NO: 6 - protein, 12 aa, Artificial Sequence
  Description of Artificial Sequence: Synthetic peptide
GDSLSWLLRSLN

SEQ ID NO: 7 - protein, 17 aa, Artificial Sequence
  Description of Artificial Sequence: Synthetic peptide
GSQDVLDSLEFIASKLA

SEQ ID NO: 8 - protein, 13 aa, Artificial Sequence
  Description of Artificial Sequence: Synthetic peptide
VLDSLEFIASKLA

SEQ ID NO: 9 - protein, 11 aa, Artificial Sequence
  Description of Artificial Sequence: Synthetic peptide
DSLEFIASKLA

SEQ ID NO: 10 - protein, 12 aa, Artificial Sequence
  Description of Artificial Sequence: Synthetic peptide
GDSLDMLEWSLM

SEQ ID NO: 11 - protein, 11 aa, Artificial Sequence
  Description of Artificial Sequence: Synthetic peptide
GDSLDMLEWSL

SEQ ID NO: 12 - protein, 10 aa, Artificial Sequence
  Description of Artificial Sequence: Synthetic peptide
GDSLDMLEWS

SEQ ID NO: 13 - protein, 9 aa, Artificial Sequence
  Description of Artificial Sequence: Synthetic peptide
GDSLDMLEW

SEQ ID NO: 14 - protein, 8 aa, Artificial Sequence
  Description of Artificial Sequence: Synthetic peptide
DSLDMLEW

SEQ ID NO: 15 - protein, 6 aa, Artificial Sequence
  Description of Artificial Sequence: Synthetic peptide
GDSLDM

SEQ ID NO: 16 - protein, 12 aa, Artificial Sequence
  Description of Artificial Sequence: Synthetic peptide
LDSVRMMALAAR

SEQ ID NO: 17 - protein, 12 aa, Artificial Sequence
  Description of Artificial Sequence: Synthetic peptide
LDSLDMLEWSLR

SEQ ID NO: 18 - protein, 10 aa, Artificial Sequence
  Description of Artificial Sequence: Synthetic peptide
DSLEFIASKL

SEQ ID NO: 19 - protein, 9 aa, Artificial Sequence
  Description of Artificial Sequence: Synthetic peptide
DSLEFIASK

SEQ ID NO: 20 - protein, 9 aa, Artificial Sequence
  Description of Artificial Sequence: Synthetic peptide
DVLDSLEFI

SEQ ID NO: 21 - protein, 10 aa, Artificial Sequence
  Description of Artificial Sequence: Synthetic peptide
VLDSLEFIAS

SEQ ID NO: 22 - protein, 316 aa, Homo sapiens
  PPTase (with N-terminal His6 tag after signal peptide cleavage)
QPHHHHHHVFPAKRFCLVPSMEGVRWAFSCGTWLPSRAEWLLAVRSIQPEEKERIGQFVFARDAKAAMAGRLMIRKLVAEKLNIPWNHIRLQRTAKGKPVLAKDSSNPYPNFNFNISHQGDYAVLAAEPELQVGIDIMKTSFPGRGSIPEFFHIMKRKFTNKEWETIRSFKDEWTQLDMFYRNWALKESFIKAIGVGLGFELQRLEFDLSPLNLDIGQVYKETRLFLDGEEEKEWAFEESKIDEHHFVAVALRKPDGSRHQDVPSQDDSKPTQRQFTILNFNDLMSSAVPMTPEDPSFWDCFCFTEEIPIRNGTKS

SEQ ID NO: 23 - protein, 316 aa, Homo sapiens
  PPTase (with C-terminal His6 tag after signal peptide cleavage)
QPVFPAKRFCLVPSMEGVRWAFSCGTWLPSRAEWLLAVRSIQPEEKERIGQFVFARDAKAAMAGRLMIRKLVAEKLNIPWNHIRLQRTAKGKPVLAKDSSNPYPNFNFNISHQGDYAVLAAEPELQVGIDIMKTSFPGRGSIPEFFHIMKRKFTNKEWETIRSFKDEWTQLDMFYRNWALKESFIKAIGVGLGFELQRLEFDLSPLNLDIGQVYKETRLFLDGEEEKEWAFEESKIDEHHFVAVALRKPDGSRHQDVPSQDDSKPTQRQFTILNFNDLMSSAVPMTPEDPSFWDCFCFTEEIPIRNGTKSHHHHHH

SEQ ID NO: 24 - protein, 106 aa, Homo sapiens
  Ig kappa light chain C region
  MOD_RES (45)..(45): Val or Ala
  MOD_RES (83)..(83): Leu or Val
TVAAPSVFIFPPSDEQLKSGTASVVCLLNNFYPREAKVQWKVDNXLQSGNSQESVTEQDSKDSTYSLSSTLTLSKADYEKHKXYACEVTHQGLSSPVTKSFNRGEC

SEQ ID NO: 25 - protein, 104 aa, Artificial Sequence
  Description of Artificial Sequence: Synthetic mAb2-LC polypeptide
PKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 26 - protein, 226 aa, Artificial Sequence
  Description of Artificial Sequence: Synthetic anti-hHER2-LC-I2-GDSLSWLLRLLN-Q3 polypeptide
DIGDSLSWLLRLLNQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27 - protein, 225 aa, Artificial Sequence
  Description of Artificial Sequence: Synthetic anti-hHER2-LC-I2-DSLEFIASKLA-Q3 polypeptide
DIDSLEFIASKLAQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28 - protein, 118 aa, Artificial Sequence
  Description of Artificial Sequence: Synthetic anti-hHER2-LC-C214-GDSLSWLLRLLN polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGDSLSWLLRLLN

SEQ ID NO: 29 - protein, 117 aa, Artificial Sequence
  Description of Artificial Sequence: Synthetic anti-hHER2-LC-C214-DSLEFIASKLA polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDSLEFIASKLA

SEQ ID NO: 30 - protein, 222 aa, Artificial Sequence
  Description of Artificial Sequence: Synthetic anti-hHER2-LC-S76D-S77-L78-EFIASKLA-Q79 polypeptide
DIQMTQSPSSLSASVGDRVTITCRASQDVNTAVAWYQQKPGKAPKLLIYSASFLYSGVPSRFSGSRSGTDFTLTIDSLEFIASKLAQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 31 - protein, 118 aa, Artificial Sequence
  Description of Artificial Sequence: Synthetic anti-hHER2-LC-T109-GDSLSWLLRLLN-V110 polypeptide
TGDSLSWLLRLLNVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32 - protein, 118 aa, Artificial Sequence
  Description of Artificial Sequence: Synthetic anti-hHER2-LC-V110-GDSLSWLLRLLN-A111 polypeptide
TVGDSLSWLLRLLNAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33 - protein, 118 aa, Artificial Sequence
  Description of Artificial Sequence: Synthetic anti-hHER2-LC-A111-GDSLSWLLRLLN-A112 polypeptide
TVAGDSLSWLLRLLNAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 34 - protein, 118 aa, Artificial Sequence
  Description of Artificial Sequence: Synthetic anti-hHER2-LC-P119-GDSLSWLLRLLN-P120 polypeptide
TVAAPSVFIFPGDSLSWLLRLLNPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35 - protein, 118 aa, Artificial Sequence
  Description of Artificial Sequence: Synthetic anti-hHER2-LC-P120-GDSLSWLLRLLN-S121 polypeptide
TVAAPSVFIFPPGDSLSWLLRLLNSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36 - protein, 118 aa, Artificial Sequence
  Description of Artificial Sequence: Synthetic anti-hHER2-LC-S121-GDSLSWLLRLLN-D122 polypeptide
TVAAPSVFIFPPSGDSLSWLLRLLNDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 37 - protein, 118 aa, Artificial Sequence
  Description of Artificial Sequence: Synthetic anti-hHER2-LC-D122-GDSLSWLLRLLN-E123 polypeptide
TVAAPSVFIFPPSDGDSLSWLLRLLNEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 38 - protein, 118 aa, Artificial Sequence
  Description of Artificial Sequence: Synthetic anti-hHER2-LC-Y140-GDSLSWLLRLLN-P141 polypeptide
TVAAPSVFIFPPSDEQLKSGTASVVCLLNNFYGDSLSWLLRLLNPREAKVQWKVDNALQSGNSQESVTEQDSKDSTYSLSSTLTLSKADYEKHKVYACEVTHQGLSSPVTKSFNRGEC

SEQ ID NO: 39 - protein, 118 aa, Artificial Sequence
  Description of Artificial Sequence: Synthetic anti-hHER2-LC-P141-GDSLSWLLRLLN-R142 polypeptide
TVAAPSVFIFPPSDEQLKSGTASVVCLLNNFYPGDSLSWLLRLLNREAKVQWKVDNALQSGNSQESVTEQDSKDSTYSLSSTLTLSKADYEKHKVYACEVTHQGLSSPVTKSFNRGEC

SEQ ID NO: 40 - protein, 118 aa, Artificial Sequence
  Description of Artificial Sequence: Synthetic anti-hHER2-LC-R142-GDSLSWLLRLLN-E143 polypeptide
TVAAPSVFIFPPSDEQLKSGTASVVCLLNNFYPRGDSLSWLLRLLNEAKVQWKVDNALQSGNSQESVTEQDSKDSTYSLSSTLTLSKADYEKHKVYACEVTHQGLSSPVTKSFNRGEC

SEQ ID NO: 41 - protein, 118 aa, Artificial Sequence
  Description of Artificial Sequence: Synthetic anti-hHER2-LC-E143-GDSLSWLLRLLN-A144 polypeptide
TVAAPSVFIFPPSDEQLKSGTASVVCLLNNFYPREGDSLSWLLRLLNAKVQWKVDNALQSGNSQESVTEQDSKDSTYSLSSTLTLSKADYEKHKVYACEVTHQGLSSPVTKSFNRGEC

SEQ ID NO: 42 - protein, 118 aa, Artificial Sequence
  Description of Artificial Sequence: Synthetic anti-hHER2-LC-D151-GDSLSWLLRLLN-N152 polypeptide
TVAAPSVFIFPPSDEQLKSGTASVVCLLNNFYPREAKVQWKVDGDSLSWLLRLLNNALQSGNSQESVTEQDSKDSTYSLSSTLTLSKADYEKHKVYACEVTHQGLSSPVTKSFNRGEC

SEQ ID NO: 43 - protein, 118 aa, Artificial Sequence
  Description of Artificial Sequence: Synthetic anti-hHER2-LC-N152-GDSLSWLLRLLN-A153 polypeptide
TVAAPSVFIFPPSDEQLKSGTASVVCLLNNFYPREAKVQWKVDNGDSLSWLLRLLNALQSGNSQESVTEQDSKDSTYSLSSTLTLSKADYEKHKVYACEVTHQGLSSPVTKSFNRGEC

SEQ ID NO: 44 - protein, 118 aa, Artificial Sequence
  Description of Artificial Sequence: Synthetic anti-hHER2-LC-A153-GDSLSWLLRLLN-L154 polypeptide
TVAAPSVFIFPPSDEQLKSGTASVVCLLNNFYPREAKVQWKVDNAGDSLSWLLRLLNLQSGNSQESVTEQDSKDSTYSLSSTLTLSKADYEKHKVYACEVTHQGLSSPVTKSFNRGEC

SEQ ID NO: 45 - protein, 118 aa, Artificial Sequence
  Description of Artificial Sequence: Synthetic anti-hHER2-LC-L154-GDSLSWLLRLLN-Q155 polypeptide
TVAAPSVFIFPPSDEQLKSGTASVVCLLNNFYPREAKVQWKVDNALGDSLSWLLRLLNQSGNSQESVTEQDSKDSTYSLSSTLTLSKADYEKHKVYACEVTHQGLSSPVTKSFNRGEC

SEQ ID NO: 46 - protein, 118 aa, Artificial Sequence
  Description of Artificial Sequence: Synthetic anti-hHER2-LC-Q155-GDSLSWLLRLLN-S156 polypeptide
TVAAPSVFIFPPSDEQLKSGTASVVCLLNNFYPREAKVQWKVDNALQGDSLSWLLRLLNSGNSQESVTEQDSKDSTYSLSSTLTLSKADYEKHKVYACEVTHQGLSSPVTKSFNRGEC

SEQ ID NO: 47 - protein, 118 aa, Artificial Sequence
  Description of Artificial Sequence: Synthetic anti-hHER2-LC-E161-GDSLSWLLRLLN-S162 polypeptide
TVAAPSVFIFPPSDEQLKSGTASVVCLLNNFYPREAKVQWKVDNALQSGNSQEGDSLSWLLRLLNSVTEQDSKDSTYSLSSTLTLSKADYEKHKVYACEVTHQGLSSPVTKSFNRGEC

SEQ ID NO: 48 - protein, 118 aa, Artificial Sequence
  Description of Artificial Sequence: Synthetic anti-hHER2-LC-S162-GDSLSWLLRLLN-V163 polypeptide
TVAAPSVFIFPPSDEQLKSGTASVVCLLNNFYPREAKVQWKVDNALQSGNSQESGDSLSWLLRLLNVTEQDSKDSTYSLSSTLTLSKADYEKHKVYACEVTHQGLSSPVTKSFNRGEC

SEQ ID NO: 49 - protein, 118 aa, Artificial Sequence
  Description of Artificial Sequence: Synthetic anti-hHER2-LC-V163-GDSLSWLLRLLN-T164 polypeptide
TVAAPSVFIFPPSDEQLKSGTASVVCLLNNFYPREAKVQWKVDNALQSGNSQESVGDSLSWLLRLLNTEQDSKDSTYSLSSTLTLSKADYEKHKVYACEVTHQGLSSPVTKSFNRGEC

SEQ ID NO: 50 - protein, 118 aa, Artificial Sequence
  Description of Artificial Sequence: Synthetic anti-hHER2-LC-T164-GDSLSWLLRLLN-E165 polypeptide
TVAAPSVFIFPPSDEQLKSGTASVVCLLNNFYPREAKVQWKVDNALQSGNSQESVTGDSLSWLLRLLNEQDSKDSTYSLSSTLTLSKADYEKHKVYACEVTHQGLSSPVTKSFNRGEC

SEQ ID NO: 51 - protein, 118 aa, Artificial Sequence
  Description of Artificial Sequence: Synthetic anti-hHER2-LC-E165-GDSLSWLLRLLN-Q166 polypeptide
TVAAPSVFIFPPSDEQLKSGTASVVCLLNNFYPREAKVQWKVDNALQSGNSQESVTEGDSLSWLLRLLNQDSKDSTYSLSSTLTLSKADYEKHKVYACEVTHQGLSSPVTKSFNRGEC

SEQ ID NO: 52 - protein, 118 aa, Artificial Sequence
  Description of Artificial Sequence: Synthetic anti-hHER2-LC-Q166-GDSLSWLLRLLN-D167 polypeptide
TVAAPSVFIFPPSDEQLKSGTASVVCLLNNFYPREAKVQWKVDNALQSGNSQESVTEQGDSLSWLLRLLNDSKDSTYSLSSTLTLSKADYEKHKVYACEVTHQGLSSPVTKSFNRGEC

SEQ ID NO: 53 - protein, 118 aa, Artificial Sequence
  Description of Artificial Sequence: Synthetic anti-hHER2-LC-D167-GDSLSWLLRLLN-S168 polypeptide
TVAAPSVFIFPPSDEQLKSGTASVVCLLNNFYPREAKVQWKVDNALQSGNSQESVTEQDGDSLSWLLRLLNSKDSTYSLSSTLTLSKADYEKHKVYACEVTHQGLSSPVTKSFNRGEC

SEQ ID NO: 54 - protein, 118 aa, Artificial Sequence
  Description of Artificial Sequence: Synthetic anti-hHER2-LC-T197-GDSLSWLLRLLN-H198 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTGDSLSWLLRLLNHQGLSSPVTKSFNRGEC

SEQ ID NO: 55 - protein, 118 aa, Artificial Sequence
  Description of Artificial Sequence: Synthetic anti-hHER2-LC-H198-GDSLSWLLRLLN-Q199 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHGDSLSWLLRLLNQGLSSPVTKSFNRGEC

SEQ ID NO: 56 - protein, 118 aa, Artificial Sequence
  Description of Artificial Sequence: Synthetic anti-hHER2-LC-Q199-GDSLSWLLRLLN-G200 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGDSLSWLLRLLNGLSSPVTKSFNRGEC

SEQ ID NO: 57 - protein, 118 aa, Artificial Sequence
  Description of Artificial Sequence: Synthetic anti-hHER2-LC-G200-GDSLSWLLRLLN-L201 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGGDSLSWLLRLLNLSSPVTKSFNRGEC

SEQ ID NO: 58 - protein, 118 aa, Artificial Sequence
  Description of Artificial Sequence: Synthetic anti-hHER2-LC-L201-GDSLSWLLRLLN-S202 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLGDSLSWLLRLLNSSPVTKSFNRGEC

SEQ ID NO: 59 - protein, 118 aa, Artificial Sequence
  Description of Artificial Sequence: Synthetic anti-hHER2-LC-S202-GDSLSWLLRLLN-S203 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSGDSLSWLLRLLNSPVTKSFNRGEC

SEQ ID NO: 60 - protein, 118 aa, Artificial Sequence
  Description of Artificial Sequence: Synthetic anti-hHER2-LC-S203-GDSLSWLLRLLN-P204 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSGDSLSWLLRLLNPVTKSFNRGEC

SEQ ID NO: 61 - protein, 118 aa, Artificial Sequence
  Description of Artificial Sequence: Synthetic anti-hHER2-LC-K207-GDSLSWLLRLLN-S208 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKGDSLSWLLRLLNSFNRGEC

SEQ ID NO: 62 - protein, 117 aa, Artificial Sequence
  Description of Artificial Sequence: Synthetic anti-hHER2-LC-T109-DSLEFIASKLA-V110 polypeptide
TDSLEFIASKLAVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 63 - protein, 117 aa, Artificial Sequence
  Description of Artificial Sequence: Synthetic anti-hHER2-LC-V110-DSLEFIASKLA-A111 polypeptide
TVDSLEFIASKLAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 64 - protein, 117 aa, Artificial Sequence
  Description of Artificial Sequence: Synthetic anti-hHER2-LC-A111-DSLEFIASKLA-A112 polypeptide
TVADSLEFIASKLAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 65 - protein, 117 aa, Artificial Sequence
  Description of Artificial Sequence: Synthetic anti-hHER2-LC-P119-DSLEFIASKLA-P120 polypeptide
TVAAPSVFIFPDSLEFIASKLAPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 66 - protein, 117 aa, Artificial Sequence
  Description of Artificial Sequence: Synthetic anti-hHER2-LC-P120-DSLEFIASKLA-S121 polypeptide
TVAAPSVFIFPPDSLEFIASKLASDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 67 - protein, 117 aa, Artificial Sequence
  Description of Artificial Sequence: Synthetic anti-hHER2-LC-S121-DSLEFIASKLA-D122 polypeptide
TVAAPSVFIFPPSDSLEFIASKLADEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 68 - protein, 117 aa, Artificial Sequence
  Description of Artificial Sequence: Synthetic anti-hHER2-LC-D122-DSLEFIASKLA-E123 polypeptide
TVAAPSVFIFPPSDDSLEFIASKLAEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 69 - protein, 117 aa, Artificial Sequence
  Description of Artificial Sequence: Synthetic anti-hHER2-LC-Y140-DSLEFIASKLA-P141 polypeptide
TVAAPSVFIFPPSDEQLKSGTASVVCLLNNFYDSLEFIASKLAPREAKVQWKVDNALQSGNSQESVTEQDSKDSTYSLSSTLTLSKADYEKHKVYACEVTHQGLSSPVTKSFNRGEC

SEQ ID NO: 70 - protein, 117 aa, Artificial Sequence
  Description of Artificial Sequence: Synthetic anti-hHER2-LC-P141-DSLEFIASKLA-R142 polypeptide
TVAAPSVFIFPPSDEQLKSGTASVVCLLNNFYPDSLEFIASKLAREAKVQWKVDNALQSGNSQESVTEQDSKDSTYSLSSTLTLSKADYEKHKVYACEVTHQGLSSPVTKSFNRGEC

SEQ ID NO: 71 - protein, 117 aa, Artificial Sequence
  Description of Artificial Sequence: Synthetic anti-hHER2-LC-R142-DSLEFIASKLA-E143 polypeptide
TVAAPSVFIFPPSDEQLKSGTASVVCLLNNFYPRDSLEFIASKLAEAKVQWKVDNALQSGNSQESVTEQDSKDSTYSLSSTLTLSKADYEKHKVYACEVTHQGLSSPVTKSFNRGEC

SEQ ID NO: 72 - protein, 117 aa, Artificial Sequence
  Description of Artificial Sequence: Synthetic anti-hHER2-LC-E143-DSLEFIASKLA-A144 polypeptide
TVAAPSVFIFPPSDEQLKSGTASVVCLLNNFYPREDSLEFIASKLAAKVQWKVDNALQSGNSQESVTEQDSKDSTYSLSSTLTLSKADYEKHKVYACEVTHQGLSSPVTKSFNRGEC

SEQ ID NO: 73 - protein, 117 aa, Artificial Sequence
  Description of Artificial Sequence: Synthetic anti-hHER2-LC-D151-DSLEFIASKLA-N152 polypeptide
TVAAPSVFIFPPSDEQLKSGTASVVCLLNNFYPREAKVQWKVDDSLEFIASKLANALQSGNSQESVTEQDSKDSTYSLSSTLTLSKADYEKHKVYACEVTHQGLSSPVTKSFNRGEC

SEQ ID NO: 74 - protein, 117 aa, Artificial Sequence
  Description of Artificial Sequence: Synthetic anti-hHER2-LC-N152-DSLEFIASKLA-A153 polypeptide
TVAAPSVFIFPPSDEQLKSGTASVVCLLNNFYPREAKVQWKVDNDSLEFIASKLAALQSGNSQESVTEQDSKDSTYSLSSTLTLSKADYEKHKVYACEVTHQGLSSPVTKSFNRGEC

SEQ ID NO: 75 - protein, 117 aa, Artificial Sequence
  Description of Artificial Sequence: Synthetic anti-hHER2-LC-A153-DSLEFIASKLA-L154 polypeptide
TVAAPSVFIFPPSDEQLKSGTASVVCLLNNFYPREAKVQWKVDNADSLEFIASKLALQSGNSQESVTEQDSKDSTYSLSSTLTLSKADYEKHKVYACEVTHQGLSSPVTKSFNRGEC

SEQ ID NO: 76 - protein, 117 aa, Artificial Sequence
  Description of Artificial Sequence: Synthetic anti-hHER2-LC-L154-DSLEFIASKLA-Q155 polypeptide
TVAAPSVFIFPPSDEQLKSGTASVVCLLNNFYPREAKVQWKVDNALDSLEFIASKLAQSGNSQESVTEQDSKDSTYSLSSTLTLSKADYEKHKVYACEVTHQGLSSPVTKSFNRGEC

SEQ ID NO: 77 - protein, 117 aa, Artificial Sequence
  Description of Artificial Sequence: Synthetic anti-hHER2-LC-Q155-DSLEFIASKLA-S156 polypeptide
TVAAPSVFIFPPSDEQLKSGTASVVCLLNNFYPREAKVQWKVDNALQDSLEFIASKLASGNSQESVTEQDSKDSTYSLSSTLTLSKADYEKHKVYACEVTHQGLSSPVTKSFNRGEC

SEQ ID NO: 78 - protein, 117 aa, Artificial Sequence
  Description of Artificial Sequence: Synthetic anti-hHER2-LC-E161-DSLEFIASKLA-S162 polypeptide
TVAAPSVFIFPPSDEQLKSGTASVVCLLNNFYPREAKVQWKVDNALQSGNSQEDSLEFIASKLASVTEQDSKDSTYSLSSTLTLSKADYEKHKVYACEVTHQGLSSPVTKSFNRGEC

SEQ ID NO: 79 - protein, 117 aa, Artificial Sequence
  Description of Artificial Sequence: Synthetic anti-hHER2-LC-S162-DSLEFIASKLA-V163 polypeptide
TVAAPSVFIFPPSDEQLKSGTASVVCLLNNFYPREAKVQWKVDNALQSGNSQESDSLEFIASKLAVTEQDSKDSTYSLSSTLTLSKADYEKHKVYACEVTHQGLSSPVTKSFNRGEC

SEQ ID NO: 80 - protein, 117 aa, Artificial Sequence
  Description of Artificial Sequence: Synthetic anti-hHER2-LC-V163-DSLEFIASKLA-T164 polypeptide
TVAAPSVFIFPPSDEQLKSGTASVVCLLNNFYPREAKVQWKVDNALQSGNSQESVDSLEFIASKLATEQDSKDSTYSLSSTLTLSKADYEKHKVYACEVTHQGLSSPVTKSFNRGEC

SEQ ID NO: 81 - protein, 117 aa, Artificial Sequence
  Description of Artificial Sequence: Synthetic anti-hHER2-LC-T164-DSLEFIASKLA-E165 polypeptide
TVAAPSVFIFPPSDEQLKSGTASVVCLLNNFYPREAKVQWKVDNALQSGNSQESVTDSLEFIASKLAEQDSKDSTYSLSSTLTLSKADYEKHKVYACEVTHQGLSSPVTKSFNRGEC

SEQ ID NO: 82 - protein, 117 aa, Artificial Sequence
  Description of Artificial Sequence: Synthetic anti-hHER2-LC-E165-DSLEFIASKLA-Q166 polypeptide
TVAAPSVFIFPPSDEQLKSGTASVVCLLNNFYPREAKVQWKVDNALQSGNSQESVTEDSLEFIASKLAQDSKDSTYSLSSTLTLSKADYEKHKVYACEVTHQGLSSPVTKSFNRGEC

SEQ ID NO: 83 - protein, 117 aa, Artificial Sequence
  Description of Artificial Sequence: Synthetic anti-hHER2-LC-Q166-DSLEFIASKLA-D167 polypeptide
TVAAPSVFIFPPSDEQLKSGTASVVCLLNNFYPREAKVQWKVDNALQSGNSQESVTEQDSLEFIASKLADSKDSTYSLSSTLTLSKADYEKHKVYACEVTHQGLSSPVTKSFNRGEC

SEQ ID NO: 84 - protein, 117 aa, Artificial Sequence
  Description of Artificial Sequence: Synthetic anti-hHER2-LC-D167-DSLEFIASKLA-S168 polypeptide
TVAAPSVFIFPPSDEQLKSGTASVVCLLNNFYPREAKVQWKVDNALQSGNSQESVTEQDDSLEFIASKLASKDSTYSLSSTLTLSKADYEKHKVYACEVTHQGLSSPVTKSFNRGEC

SEQ ID NO: 85 - protein, 117 aa, Artificial Sequence
  Description of Artificial Sequence: Synthetic anti-hHER2-LC-T197-DSLEFIASKLA-H198 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTDSLEFIASKLAHQGLSSPVTKSFNRGEC

SEQ ID NO: 86 - protein, 117 aa, Artificial Sequence
  Description of Artificial Sequence: Synthetic anti-hHER2-LC-H198-DSLEFIASKLA-Q199 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHDSLEFIASKLAQGLSSPVTKSFNRGEC

SEQ ID NO: 87 - protein, 117 aa, Artificial Sequence
  Description of Artificial Sequence: Synthetic anti-hHER2-LC-Q199-DSLEFIASKLA-G200 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQDSLEFIASKLAGLSSPVTKSFNRGEC

SEQ ID NO: 88 - protein, 117 aa, Artificial Sequence
  Description of Artificial Sequence: Synthetic anti-hHER2-LC-G200-DSLEFIASKLA-L201 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGDSLEFIASKLALSSPVTKSFNRGEC

SEQ ID NO: 89 - protein, 117 aa, Artificial Sequence
  Description of Artificial Sequence: Synthetic anti-hHER2-LC-L201-DSLEFIASKLA-S202 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLDSLEFIASKLASSPVTKSFNRGEC

SEQ ID NO: 90 - protein, 117 aa, Artificial Sequence
  Description of Artificial Sequence: Synthetic anti-hHER2-LC-S202-DSLEFIASKLA-S203 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSDSLEFIASKLASPVTKSFNRGEC

SEQ ID NO: 91 - protein, 117 aa, Artificial Sequence
  Description of Artificial Sequence: Synthetic anti-hHER2-LC-S203-DSLEFIASKLA-P204 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSDSLEFIASKLAPVTKSFNRGEC

SEQ ID NO: 92 - protein, 117 aa, Artificial Sequence
  Description of Artificial Sequence: Synthetic anti-hHER2-LC-K207-DSLEFIASKLA-S208 polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKDSLEFIASKLASFNRGEC

SEQ ID NO: 93 - protein, 328 aa, Homo sapiens
  Ig gamma-1 heavy chain C region
  MOD_RES (96)..(96): Arg or Lys
  MOD_RES (238)..(238): Asp or Glu
  MOD_RES (240)..(240): Leu or Met
  MOD_RES (313)..(313): Ala or Gly
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKXVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRXEXTKNQVSLTCLVKGFYPSDIAVEWESNGQPENNYKTTPPVLDSDGSFFLYSKLTVDKSRWQQGNVFSCSVMHEXLHNHYTQKSLSLSPG

SEQ ID NO: 94 - protein, 461 aa, Artificial Sequence
  Description of Artificial Sequence: Synthetic anti-hHER2-HC-V2-GDSLSWLLRLLN-Q3 polypeptide
EVGDSLSWLLRLLNQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 95 - protein, 460 aa, Artificial Sequence
  Description of Artificial Sequence: Synthetic anti-hHER2-HC-V2-DSLEFIASKLA-Q3 polypeptide
EVDSLEFIASKLAQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 96 - protein, 461 aa, Artificial Sequence
  Description of Artificial Sequence: Synthetic anti-hHER2-HC-V2-GDSLDMLEWSLM-Q3 polypeptide
EVGDSLDMLEWSLMQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 97 - protein, 456 aa, Artificial Sequence
  Description of Artificial Sequence: Synthetic anti-hHER2-HC-S63-LEFIASK-V64 polypeptide
EVQLVESGGGLVQPGGSLRLSCAASGFNIKDTYIHWVRQAPGKGLEWVARIYPTNGYTRYADSLEFIASKVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 98 - protein, 454 aa, Artificial Sequence
  Description of Artificial Sequence: Synthetic anti-hHER2-HC-V64L-EFIAS-K65 polypeptide
EVQLVESGGGLVQPGGSLRLSCAASGFNIKDTYIHWVRQAPGKGLEWVARIYPTNGYTRYADSLEFIASKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 99 - protein, 457 aa, Artificial Sequence
  Description of Artificial Sequence: Synthetic anti-hHER2-HC-V64L-EFIASKLA-K65 polypeptide
EVQLVESGGGLVQPGGSLRLSCAASGFNIKDTYIHWVRQAPGKGLEWVARIYPTNGYTRYADSLEFIASKLAKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 100 - protein, 328 aa, Artificial Sequence
  Description of Artificial Sequence: Synthetic anti-hHER2-HC-S132G-K133D-S134-T135L-S136-G137W-G138L polypeptide
STKGPSVFPLAPSGDSLSWLTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 101 - protein, 328 aa, Artificial Sequence
  Description of Artificial Sequence: Synthetic anti-hHER2-HC-S132G-K133D-S134-T135L-S136-G137W-G138L- T139L-A140R-A141L-L142-G143N polypeptide
STKGPSVFPLAPSGDSLSWLLRLLNCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 102 - protein, 328 aa, Artificial Sequence
  Description of Artificial Sequence: Synthetic anti-hHER2-HC-S132D-K133S-S134L-T135E-S136F-G137I-G138A- T139S-A140K-A141L-L142A polypeptide
STKGPSVFPLAPSDSLEFIASKLAGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 103 - protein, 334 aa, Artificial Sequence
  Description of Artificial Sequence: Synthetic anti-hHER2-HC-K133G-S134D-T135S-S136L-G137S-G138W- LLRLLN-T139 polypeptide
STKGPSVFPLAPSSGDSLSWLLRLLNTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 104 - protein, 328 aa, Artificial Sequence
  Description of Artificial Sequence: Synthetic anti-hHER2-HC-S134G-T135D-G137L-G138S-WLLRLLN-A141 polypeptide
STKGPSVFPLAPSSKGDSLSWLALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 105 - protein, 328 aa, Artificial Sequence; identical to SEQ ID NO: 104
  Description of Artificial Sequence: Synthetic anti-hHER2-HC-S134G-T135D-S136-G137L-G138S-T139W-A140L polypeptide

SEQ ID NO: 106 - protein, 333 aa, Artificial Sequence
  Description of Artificial Sequence: Synthetic anti-hHER2-HC-S134G-T135D-S136-G137L-G138S-T139W-A140L- LRLLN-A141 polypeptide
STKGPSVFPLAPSSKGDSLSWLLRLLNALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 107 - protein, 328 aa, Artificial Sequence
  Description of Artificial Sequence: Synthetic anti-hHER2-HC-S134G-T135D-S136-G137L-G138S-T139W-A140L- A141L-L142R-G143L-C144L-L145N polypeptide
STKGPSVFPLAPSSKGDSLSWLLRLLNVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 108 - protein, 335 aa, Artificial Sequence
  Description of Artificial Sequence: Synthetic anti-hHER2-HC-T135G-S136D-G137S-G138L-T139S-WLLRLLN-A140 polypeptide
STKGPSVFPLAPSSKSGDSLSWLLRLLNAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 109 - protein, 328 aa, Artificial Sequence
  Description of Artificial Sequence: Synthetic anti-hHER2-HC-P189G-S190D-S191-S192L-L193S-G194W-T195L polypeptide
STKGPSVFPLAPSSKSTSGGTAALGCLVKDYFPEPVTVSWNSGALTSGVHTFPAVLQSSGLYSLSSVVTVGDSLSWLQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 110 - protein, 333 aa, Artificial Sequence
  Description of Artificial Sequence: Synthetic anti-hHER2-HC-P189G-S190D-S191-S192L-L193S-G194W-T195L- LRLLN-Q196 polypeptide
STKGPSVFPLAPSSKSTSGGTAALGCLVKDYFPEPVTVSWNSGALTSGVHTFPAVLQSSGLYSLSSVVTVGDSLSWLLRLLNQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 111 - protein, 328 aa, Artificial Sequence
  Description of Artificial Sequence: Synthetic anti-hHER2-HC-P189G-S190D-S191-S192L-L193S-G194W-T195L- Q196L-T197R-Y198L-I199L-C200N polypeptide
STKGPSVFPLAPSSKSTSGGTAALGCLVKDYFPEPVTVSWNSGALTSGVHTFPAVLQSSGLYSLSSVVTVGDSLSWLLRLLNNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 112 - protein, 328 aa, Artificial Sequence
  Description of Artificial Sequence: Synthetic anti-hHER2-HC-P189D-S190-S191L-S192E-L193F-G194I-T195A- Q196S-T197K-Y198L-I199A polypeptide
STKGPSVFPLAPSSKSTSGGTAALGCLVKDYFPEPVTVSWNSGALTSGVHTFPAVLQSSGLYSLSSVVTVDSLEFIASKLACNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 113 - protein, 332 aa, Artificial Sequence
  Description of Artificial Sequence: Synthetic anti-hHER2-HC-S190G-S191D-S192-L193-G194S-T195W-Q196L- T197L-RLLN-Y198 polypeptide
STKGPSVFPLAPSSKSTSGGTAALGCLVKDYFPEPVTVSWNSGALTSGVHTFPAVLQSSGLYSLSSVVTVPGDSLSWLLRLLNYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 114 - protein, 328 aa, Artificial Sequence
  Description of Artificial Sequence: Synthetic anti-hHER2-HC-S190D-S191-S192L-L193E-G194F-T195I-Q196A- T197S-Y198K-I199L polypeptide
STKGPSVFPLAPSSKSTSGGTAALGCLVKDYFPEPVTVSWNSGALTSGVHTFPAVLQSSGLYSLSSVVTVPDSLEFIASKLCNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 115 - protein, 328 aa, Artificial Sequence
  Description of Artificial Sequence: Synthetic anti-hHER2-HC-S190D-S191-S192L-L193E-G194F-T195I-Q196A- T197S-Y198K-I199L-C200A polypeptide
STKGPSVFPLAPSSKSTSGGTAALGCLVKDYFPEPVTVSWNSGALTSGVHTFPAVLQSSGLYSLSSVVTVPDSLEFIASKLANVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 116 - protein, 328 aa, Artificial Sequence
  Description of Artificial Sequence: Synthetic anti-hHER2-HC-S191D-S192-L193-G194E-T195F-Q196I-T197A- Y198S-I199K polypeptide
STKGPSVFPLAPSSKSTSGGTAALGCLVKDYFPEPVTVSWNSGALTSGVHTFPAVLQSSGLYSLSSVVTVPSDSLEFIASKCNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 117 - protein, 328 aa, Artificial Sequence
  Description of Artificial Sequence: Synthetic anti-hHER2-HC-L193G-G194D-T195S-Q196L-T197S-Y198W-I199L polypeptide
STKGPSVFPLAPSSKSTSGGTAALGCLVKDYFPEPVTVSWNSGALTSGVHTFPAVLQSSGLYSLSSVVTVPSSSGDSLSWLCNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 118 - protein, 333 aa, Artificial Sequence
  Description of Artificial Sequence: Synthetic anti-hHER2-HC-L193G-G194D-T195S-Q196L-T197S-Y198W-I199L- LRLLN-C200 polypeptide
STKGPSVFPLAPSSKSTSGGTAALGCLVKDYFPEPVTVSWNSGALTSGVHTFPAVLQSSGLYSLSSVVTVPSSSGDSLSWLLRLLNCNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 119 - protein, 328 aa, Artificial Sequence
  Description of Artificial Sequence: Synthetic anti-hHER2-HC-L193G-G194D-T195S-Q196L-T197S-Y198W-I199L- C200L-N201R-V202L-N203L-H204N polypeptide
STKGPSVFPLAPSSKSTSGGTAALGCLVKDYFPEPVTVSWNSGALTSGVHTFPAVLQSSGLYSLSSVVTVPSSSGDSLSWLLRLLNKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 120 - protein, 328 aa, Artificial Sequence
  Description of Artificial Sequence: Synthetic anti-hHER2-HC-E357G-M358D-T359S-K360L-N361S-Q362W-V363L polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREGDSLSWLSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 121 - protein, 340 aa, Artificial Sequence
  Description of Artificial Sequence: Synthetic anti-hHER2-HC-T359-GDSLSWLLRLLN-K360 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTGDSLSWLLRLLNKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 122 - protein, 339 aa, Artificial Sequence
  Description of Artificial Sequence: Synthetic anti-hHER2-HC-T359-DSLEFIASKLA-K360 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTDSLEFIASKLAKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 123 - protein, 328 aa, Artificial Sequence
  Description of Artificial Sequence: Synthetic anti-hHER2-HC-T359G-K360D-N361S-Q362L-V363S-S364W polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMGDSLSWLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 124 - protein, 328 aa, Artificial Sequence
  Description of Artificial Sequence: Synthetic anti-hHER2-HC-E382D-S383-N384L-G385S-Q386W-P387L-E388L polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWDSLSWLLNNYKTTPPVLDSDGSFFLYSKLTVDKSRWQQGNVFSCSVMHEALHNHYTQKSLSLSPG

SEQ ID NO: 125 - protein, 328 aa, Artificial Sequence
  Description of Artificial Sequence: Synthetic anti-hHER2-HC-E382D-S383-N384L-G385E-Q386F-P387I-E388A polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWDSLEFIANNYKTTPPVLDSDGSFFLYSKLTVDKSRWQQGNVFSCSVMHEALHNHYTQKSLSLSPG

SEQ ID NO: 126 - protein, 335 aa, Artificial Sequence
  Description of Artificial Sequence: Synthetic anti-hHER2-HC-E388-GDSLSWL-N389 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPEGDSLSWLNNYKTTPPVLDSDGSFFLYSKLTVDKSRWQQGNVFSCSVMHEALHNHYTQKSLSLSPG

SEQ ID NO: 127 - protein, 340 aa, Artificial Sequence
  Description of Artificial Sequence: Synthetic anti-hHER2-HC-E388-GDSLSWLLRLLN-N389 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPEGDSLSWLLRLLNNNYKTTPPVLDSDGSFFLYSKLTVDKSRWQQGNVFSCSVMHEALHNHYTQKSLSLSPG

SEQ ID NO: 128 - protein, 340 aa, Artificial Sequence
  Description of Artificial Sequence: Synthetic anti-hHER2-HC-E388-GDALSWLLRLLN-N389 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPEGDALSWLLRLLNNNYKTTPPVLDSDGSFFLYSKLTVDKSRWQQGNVFSCSVMHEALHNHYTQKSLSLSPG

SEQ ID NO: 129 - protein, 339 aa, Artificial Sequence
  Description of Artificial Sequence: Synthetic anti-hHER2-HC-E388-DSLEFIASKLA-N389 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPEDSLEFIASKLANNYKTTPPVLDSDGSFFLYSKLTVDKSRWQQGNVFSCSVMHEALHNHYTQKSLSLSPG

SEQ ID NO: 130 - protein, 338 aa, Artificial Sequence
  Description of Artificial Sequence: Synthetic anti-hHER2-HC-E388-DSLEFIASKL-N389 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPEDSLEFIASKLNNYKTTPPVLDSDGSFFLYSKLTVDKSRWQQGNVFSCSVMHEALHNHYTQKSLSLSPG

SEQ ID NO: 131 - protein, 337 aa, Artificial Sequence
  Description of Artificial Sequence: Synthetic anti-hHER2-HC-E388-DSLEFIASK-N389 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPEDSLEFIASKNNYKTTPPVLDSDGSFFLYSKLTVDKSRWQQGNVFSCSVMHEALHNHYTQKSLSLSPG

SEQ ID NO: 132 - protein, 340 aa, Artificial Sequence
  Description of Artificial Sequence: Synthetic anti-hHER2-HC-E388-GDSLDMLEWSLM-N389 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPEGDSLDMLEWSLMNNYKTTPPVLDSDGSFFLYSKLTVDKSRWQQGNVFSCSVMHEALHNHYTQKSLSLSPG

SEQ ID NO: 133 - protein, 328 aa, Artificial Sequence
  Description of Artificial Sequence: Synthetic anti-hHER2-HC-L398G-D401L-G402S-S403W-F404L polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVGDSLSWLFLYSKLTVDKSRWQQGNVFSCSVMHEALHNHYTQKSLSLSPG

SEQ ID NO: 134 - protein, 333 aa, Artificial Sequence
  Description of Artificial Sequence: Synthetic anti-hHER2-HC-L398G-D399-S400-D401L-G402S-S403W-F404L- LRLLN-F405 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVGDSLSWLLRLLNFLYSKLTVDKSRWQQGNVFSCSVMHEALHNHYTQKSLSLSPG

SEQ ID NO: 135 - protein, 328 aa, Artificial Sequence
  Description of Artificial Sequence: Synthetic anti-hHER2-HC-L398D-D399S-S400L-D401E-G402F-S403I-F404A- F405S-L406K-Y407L-S408A polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVDSLEFIASKLAKLTVDKSRWQQGNVFSCSVMHEALHNHYTQKSLSLSPG

SEQ ID NO: 136 - protein, 340 aa, Artificial Sequence
  Description of Artificial Sequence: Synthetic anti-hHER2-HC-S400-GDSLSWLLRLLN-D401 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSGDSLSWLLRLLNDGSFFLYSKLTVDKSRWQQGNVFSCSVMHEALHNHYTQKSLSLSPG

SEQ ID NO: 137 - protein, 328 aa, Artificial Sequence
  Description of Artificial Sequence: Synthetic anti-hHER2-HC-D413-K414S-S415L-R416S-W417-Q418L-Q419L- G420R-N421L-V422L polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDSLSWLLRLLFSCSVMHEALHNHYTQKSLSLSPG

SEQ ID NO: 138 - protein, 328 aa, Artificial Sequence
  Description of Artificial Sequence: Synthetic anti-hHER2-HC-D413-K414S-S415L-R416E-W417F-Q418I-Q419A- G420S-N421K-V422L polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDSLEFIASKLFSCSVMHEALHNHYTQKSLSLSPG

SEQ ID NO: 139 - protein, 340 aa, Artificial Sequence
  Description of Artificial Sequence: Synthetic anti-hHER2-HC-G446-GDSLSWLLRLLN-K447 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGDSLSWLLRLLN

SEQ ID NO: 140 - protein, 341 aa, Artificial Sequence
  Description of Artificial Sequence: Synthetic anti-hHER2-HC-K447-GDSLSWLLRLLN polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGDSLSWLLRLLN

SEQ ID NO: 141 - protein, 340 aa, Artificial Sequence
  Description of Artificial Sequence: Synthetic anti-hHER2-HC-K447-DSLEFIASKLA polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKDSLEFIASKLA

SEQ ID NO: 142 - protein, 472 aa, Artificial Sequence
  Description of Artificial Sequence: Synthetic anti-hHER2-HC-V2-GDSLSWLLRLLN-Q3-E388-DSLEFIASKLA-N389 polypeptide
EVGDSLSWLLRLLNQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPEDSLEFIASKLANNYKTTPPVLDSDGSFFLYSKLTVDKSRWQQGNVFSCSVMHEALHNHYTQKSLSLSPG

SEQ ID NO: 143 - protein, 340 aa, Artificial Sequence
  Description of Artificial Sequence: Synthetic anti-hHER2-HC-Y296-GDSLSWLLRLLN-N297 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGDSLSWLLRLLNNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 144 - protein, 339 aa, Artificial Sequence
  Description of Artificial Sequence: Synthetic anti-hHER2-HC-Y296-DSLEFIASKLA-N297 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYDSLEFIASKLANSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 145 - protein, 340 aa, Artificial Sequence
  Description of Artificial Sequence: Synthetic anti-hHER2-HC-N297-GDSLSWLLRLLN-S298 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNGDSLSWLLRLLNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 146 - protein, 339 aa, Artificial Sequence
  Description of Artificial Sequence: Synthetic anti-hHER2-HC-N297-DSLEFIASKLA-S298 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNDSLEFIASKLASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 147 - protein, 328 aa, Artificial Sequence
  Description of Artificial Sequence: Synthetic mAb2-HC polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 148 - protein, 340 aa, Artificial Sequence
  Description of Artificial Sequence: Synthetic mAb2-HC-T359-GDSLSWLLRLLN-K360 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTGDSLSWLLRLLNKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 149 - protein, 340 aa, Artificial Sequence
  Description of Artificial Sequence: Synthetic mAb2-HC-E388-GDSLSWLLRLLN-N389 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPEGDSLSWLLRLLNNNYKTTPPVLDSDGSFFLYSKLTVDKSRWQQGNVFSCSVMHEALHNHYTQKSLSLSPG

SEQ ID NO: 150 - protein, 340 aa, Artificial Sequence
  Description of Artificial Sequence: Synthetic anti-hHER2-HC-A118-GDSLSWLLRLLN-S119 polypeptide
GDSLSWLLRLLNSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 151 - protein, 340 aa, Artificial Sequence
  Description of Artificial Sequence: Synthetic anti-hHER2-HC-S119-GDSLSWLLRLLN-T120 polypeptide
SGDSLSWLLRLLNTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 152 - protein, 340 aa, Artificial Sequence
  Description of Artificial Sequence: Synthetic anti-hHER2-HC-T120-GDSLSWLLRLLN-K121 polypeptide
STGDSLSWLLRLLNKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 153 - protein, 340 aa, Artificial Sequence
  Description of Artificial Sequence: Synthetic anti-hHER2-HC-S131-GDSLSWLLRLLN-S132 polypeptide
STKGPSVFPLAPSGDSLSWLLRLLNSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 154 - protein, 340 aa, Artificial Sequence
  Description of Artificial Sequence: Synthetic anti-hHER2-HC-S132-GDSLSWLLRLLN-K133 polypeptide
STKGPSVFPLAPSSGDSLSWLLRLLNKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 155 - protein, 340 aa, Artificial Sequence
  Description of Artificial Sequence: Synthetic anti-hHER2-HC-K133-GDSLSWLLRLLN-S134 polypeptide
STKGPSVFPLAPSSKGDSLSWLLRLLNSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 156 - protein, 340 aa, Artificial Sequence
  Description of Artificial Sequence: Synthetic anti-hHER2-HC-S134-GDSLSWLLRLLN-T135 polypeptide
STKGPSVFPLAPSSKSGDSLSWLLRLLNTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 157 - protein, 340 aa, Artificial Sequence
  Description of Artificial Sequence: Synthetic anti-hHER2-HC-T135-GDSLSWLLRLLN-S136 polypeptide
STKGPSVFPLAPSSKSTGDSLSWLLRLLNSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 158 - protein, 340 aa, Artificial Sequence
  Description of Artificial Sequence: Synthetic anti-hHER2-HC-S136-GDSLSWLLRLLN-G137 polypeptide
STKGPSVFPLAPSSKSTSGDSLSWLLRLLNGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 159 - protein, 340 aa, Artificial Sequence
  Description of Artificial Sequence: Synthetic anti-hHER2-HC-G137-GDSLSWLLRLLN-G138 polypeptide
STKGPSVFPLAPSSKSTSGGDSLSWLLRLLNGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 160 - protein, 340 aa, Artificial Sequence
  Description of Artificial Sequence: Synthetic anti-hHER2-HC-G138-GDSLSWLLRLLN-T139 polypeptide
STKGPSVFPLAPSSKSTSGGGDSLSWLLRLLNTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 161 - protein, 340 aa, Artificial Sequence
  Description of Artificial Sequence: Synthetic anti-hHER2-HC-E152-GDSLSWLLRLLN-P153 polypeptide
STKGPSVFPLAPSSKSTSGGTAALGCLVKDYFPEGDSLSWLLRLLNPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 162 - protein, 340 aa, Artificial Sequence
  Description of Artificial Sequence: Synthetic anti-hHER2-HC-P153-GDSLSWLLRLLN-V154 polypeptide
STKGPSVFPLAPSSKSTSGGTAALGCLVKDYFPEPGDSLSWLLRLLNVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 163 - protein, 340 aa, Artificial Sequence
  Description of Artificial Sequence: Synthetic anti-hHER2-HC-N159-GDSLSWLLRLLN-S160 polypeptide
STKGPSVFPLAPSSKSTSGGTAALGCLVKDYFPEPVTVSWNGDSLSWLLRLLNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 164 - protein, 340 aa, Artificial Sequence
  Description of Artificial Sequence: Synthetic anti-hHER2-HC-S160-GDSLSWLLRLLN-G161 polypeptide
STKGPSVFPLAPSSKSTSGGTAALGCLVKDYFPEPVTVSWNSGDSLSWLLRLLNGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 165 - protein, 340 aa, Artificial Sequence
  Description of Artificial Sequence: Synthetic anti-hHER2-HC-G161-GDSLSWLLRLLN-A162 polypeptide
STKGPSVFPLAPSSKSTSGGTAALGCLVKDYFPEPVTVSWNSGGDSLSWLLRLLNALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 166 - protein, 340 aa, Artificial Sequence
  Description of Artificial Sequence: Synthetic anti-hHER2-HC-A162-GDSLSWLLRLLN-L163 polypeptide
STKGPSVFPLAPSSKSTSGGTAALGCLVKDYFPEPVTVSWNSGAGDSLSWLLRLLNLTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 167 - protein, 340 aa, Artificial Sequence
  Description of Artificial Sequence: Synthetic anti-hHER2-HC-L163-GDSLSWLLRLLN-T164 polypeptide
STKGPSVFPLAPSSKSTSGGTAALGCLVKDYFPEPVTVSWNSGALGDSLSWLLRLLNTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 168 - protein, 340 aa, Artificial Sequence
  Description of Artificial Sequence: Synthetic anti-hHER2-HC-T164-GDSLSWLLRLLN-S165 polypeptide
STKGPSVFPLAPSSKSTSGGTAALGCLVKDYFPEPVTVSWNSGALTGDSLSWLLRLLNSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 169 - protein, 340 aa, Artificial Sequence
  Description of Artificial Sequence: Synthetic anti-hHER2-HC-S165-GDSLSWLLRLLN-G166 polypeptide
STKGPSVFPLAPSSKSTSGGTAALGCLVKDYFPEPVTVSWNSGALTSGDSLSWLLRLLNGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 170 - protein, 340 aa, Artificial Sequence
  Description of Artificial Sequence: Synthetic anti-hHER2-HC-P171-GDSLSWLLRLLN-A172 polypeptide
STKGPSVFPLAPSSKSTSGGTAALGCLVKDYFPEPVTVSWNSGALTSGVHTFPGDSLSWLLRLLNAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 171 - protein, 340 aa, Artificial Sequence
  Description of Artificial Sequence: Synthetic anti-hHER2-HC-S176-GDSLSWLLRLLN-S177 polypeptide
STKGPSVFPLAPSSKSTSGGTAALGCLVKDYFPEPVTVSWNSGALTSGVHTFPAVLQSGDSLSWLLRLLNSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 172 - protein, 340 aa, Artificial Sequence
  Description of Artificial Sequence: Synthetic anti-hHER2-HC-S177-GDSLSWLLRLLN-G178 polypeptide
STKGPSVFPLAPSSKSTSGGTAALGCLVKDYFPEPVTVSWNSGALTSGVHTFPAVLQSSGDSLSWLLRLLNGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 173 - protein, 340 aa, Artificial Sequence
  Description of Artificial Sequence: Synthetic anti-hHER2-HC-P189-GDSLSWLLRLLN-S190 polypeptide
STKGPSVFPLAPSSKSTSGGTAALGCLVKDYFPEPVTVSWNSGALTSGVHTFPAVLQSSGLYSLSSVVTVPGDSLSWLLRLLNSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 174 - protein, 340 aa, Artificial Sequence
  Description of Artificial Sequence: Synthetic anti-hHER2-HC-S190-GDSLSWLLRLLN-S191 polypeptide
STKGPSVFPLAPSSKSTSGGTAALGCLVKDYFPEPVTVSWNSGALTSGVHTFPAVLQSSGLYSLSSVVTVPSGDSLSWLLRLLNSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 175 - protein, 340 aa, Artificial Sequence
  Description of Artificial Sequence: Synthetic anti-hHER2-HC-S191-GDSLSWLLRLLN-S192 polypeptide
STKGPSVFPLAPSSKSTSGGTAALGCLVKDYFPEPVTVSWNSGALTSGVHTFPAVLQSSGLYSLSSVVTVPSSGDSLSWLLRLLNSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 176 - protein, 340 aa, Artificial Sequence
  Description of Artificial Sequence: Synthetic anti-hHER2-HC-S192-GDSLSWLLRLLN-L193 polypeptide
STKGPSVFPLAPSSKSTSGGTAALGCLVKDYFPEPVTVSWNSGALTSGVHTFPAVLQSSGLYSLSSVVTVPSSSGDSLSWLLRLLNLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 177 - protein, 340 aa, Artificial Sequence
  Description of Artificial Sequence: Synthetic anti-hHER2-HC-L193-GDSLSWLLRLLN-G194 polypeptide
STKGPSVFPLAPSSKSTSGGTAALGCLVKDYFPEPVTVSWNSGALTSGVHTFPAVLQSSGLYSLSSVVTVPSSSLGDSLSWLLRLLNGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 178 - protein, 340 aa, Artificial Sequence
  Description of Artificial Sequence: Synthetic anti-hHER2-HC-G194-GDSLSWLLRLLN-T195 polypeptide
STKGPSVFPLAPSSKSTSGGTAALGCLVKDYFPEPVTVSWNSGALTSGVHTFPAVLQSSGLYSLSSVVTVPSSSLGGDSLSWLLRLLNTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 179 - protein, 340 aa, Artificial Sequence
  Description of Artificial Sequence: Synthetic anti-hHER2-HC-T195-GDSLSWLLRLLN-Q196 polypeptide
STKGPSVFPLAPSSKSTSGGTAALGCLVKDYFPEPVTVSWNSGALTSGVHTFPAVLQSSGLYSLSSVVTVPSSSLGTGDSLSWLLRLLNQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 180 - protein, 340 aa, Artificial Sequence
  Description of Artificial Sequence: Synthetic anti-hHER2-HC-Q196-GDSLSWLLRLLN-T197 polypeptide
STKGPSVFPLAPSSKSTSGGTAALGCLVKDYFPEPVTVSWNSGALTSGVHTFPAVLQSSGLYSLSSVVTVPSSSLGTQGDSLSWLLRLLNTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 181 - protein, 340 aa, Artificial Sequence
  Description of Artificial Sequence: Synthetic anti-hHER2-HC-K205-GDSLSWLLRLLN-P206 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKGDSLSWLLRLLNPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 182 - protein, 340 aa, Artificial Sequence
  Description of Artificial Sequence: Synthetic anti-hHER2-HC-P206-GDSLSWLLRLLN-S207 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPGDSLSWLLRLLNSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 183 - protein, 340 aa, Artificial Sequence
  Description of Artificial Sequence: Synthetic anti-hHER2-HC-S207-GDSLSWLLRLLN-N208 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSGDSLSWLLRLLNNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 184 - protein, 340 aa, Artificial Sequence
  Description of Artificial Sequence: Synthetic anti-hHER2-HC-P230-GDSLSWLLRLLN-A231 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPGDSLSWLLRLLNAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 185 - protein, 340 aa, Artificial Sequence
  Description of Artificial Sequence: Synthetic anti-hHER2-HC-A231-GDSLSWLLRLLN-P232 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAGDSLSWLLRLLNPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 186 - protein, 340 aa, Artificial Sequence
  Description of Artificial Sequence: Synthetic anti-hHER2-HC-P232-GDSLSWLLRLLN-E233 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPGDSLSWLLRLLNELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 187 - protein, 340 aa, Artificial Sequence
  Description of Artificial Sequence: Synthetic anti-hHER2-HC-E233-GDSLSWLLRLLN-L234 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEGDSLSWLLRLLNLLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 188 - protein, 340 aa, Artificial Sequence
  Description of Artificial Sequence: Synthetic anti-hHER2-HC-L234-GDSLSWLLRLLN-L235 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELGDSLSWLLRLLNLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 189 - protein, 340 aa, Artificial Sequence
  Description of Artificial Sequence: Synthetic anti-hHER2-HC-L235-GDSLSWLLRLLN-G236 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGDSLSWLLRLLNGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 190 - protein, 340 aa, Artificial Sequence
  Description of Artificial Sequence: Synthetic anti-hHER2-HC-G236-GDSLSWLLRLLN-G237 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGDSLSWLLRLLNGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 191 - protein, 340 aa, Artificial Sequence
  Description of Artificial Sequence: Synthetic anti-hHER2-HC-P244-GDSLSWLLRLLN-P245 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPGDSLSWLLRLLNPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 192 - protein, 340 aa, Artificial Sequence
  Description of Artificial Sequence: Synthetic anti-hHER2-HC-P245-GDSLSWLLRLLN-K246 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPGDSLSWLLRLLNKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 193 - protein, 340 aa, Artificial Sequence
  Description of Artificial Sequence: Synthetic anti-hHER2-HC-I253-GDSLSWLLRLLN-S254 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMIGDSLSWLLRLLNSRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 194 - protein, 340 aa, Artificial Sequence
  Description of Artificial Sequence: Synthetic anti-hHER2-HC-S254-GDSLSWLLRLLN-R255 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISGDSLSWLLRLLNRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 195 - protein, 340 aa, Artificial Sequence
  Description of Artificial Sequence: Synthetic anti-hHER2-HC-R255-GDSLSWLLRLLN-T256 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRGDSLSWLLRLLNTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 196 - protein, 340 aa, Artificial Sequence
  Description of Artificial Sequence: Synthetic anti-hHER2-HC-T256-GDSLSWLLRLLN-P257 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTGDSLSWLLRLLNPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 197 - protein, 340 aa, Artificial Sequence
  Description of Artificial Sequence: Synthetic anti-hHER2-HC-P257-GDSLSWLLRLLN-E258 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPGDSLSWLLRLLNEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 198 - protein, 340 aa, Artificial Sequence
  Description of Artificial Sequence: Synthetic anti-hHER2-HC-S267-GDSLSWLLRLLN-H268 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSGDSLSWLLRLLNHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 199 - protein, 340 aa, Artificial Sequence
  Description of Artificial Sequence: Synthetic anti-hHER2-HC-H268-GDSLSWLLRLLN-E269 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHGDSLSWLLRLLNEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 200 - protein, 340 aa, Artificial Sequence
  Description of Artificial Sequence: Synthetic anti-hHER2-HC-E269-GDSLSWLLRLLN-D270 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEGDSLSWLLRLLNDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 201 - protein, 340 aa, Artificial Sequence
  Description of Artificial Sequence: Synthetic anti-hHER2-HC-D270-GDSLSWLLRLLN-P271 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDGDSLSWLLRLLNPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 202 - protein, 340 aa, Artificial Sequence
  Description of Artificial Sequence: Synthetic anti-hHER2-HC-P271-GDSLSWLLRLLN-E272 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPGDSLSWLLRLLNEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 203 - protein, 340 aa, Artificial Sequence
  Description of Artificial Sequence: Synthetic anti-hHER2-HC-D280-GDSLSWLLRLLN-G281 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGDSLSWLLRLLNGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 204 - protein, 340 aa, Artificial Sequence
  Description of Artificial Sequence: Synthetic anti-hHER2-HC-H285-GDSLSWLLRLLN-N286 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHGDSLSWLLRLLNNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 205 - protein, 340 aa, Artificial Sequence
  Description of Artificial Sequence: Synthetic anti-hHER2-HC-N286-GDSLSWLLRLLN-A287 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNGDSLSWLLRLLNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 206 - protein, 340 aa, Artificial Sequence
  Description of Artificial Sequence: Synthetic anti-hHER2-HC-P291-GDSLSWLLRLLN-R292 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPGDSLSWLLRLLNREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 207 - protein, 340 aa, Artificial Sequence
  Description of Artificial Sequence: Synthetic anti-hHER2-HC-T307-GDSLSWLLRLLN-V308 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTGDSLSWLLRLLNVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 208 - protein, 340 aa, Artificial Sequence
  Description of Artificial Sequence: Synthetic anti-hHER2-HC-V308-GDSLSWLLRLLN-L309 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVGDSLSWLLRLLNLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 209 - protein, 340 aa, Artificial Sequence
  Description of Artificial Sequence: Synthetic anti-hHER2-HC-L309-GDSLSWLLRLLN-H310 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLGDSLSWLLRLLNHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 210 - protein, 340 aa, Artificial Sequence
  Description of Artificial Sequence: Synthetic anti-hHER2-HC-H310-GDSLSWLLRLLN-Q311 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHGDSLSWLLRLLNQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 211 - protein, 340 aa, Artificial Sequence
  Description of Artificial Sequence: Synthetic anti-hHER2-HC-N315-GDSLSWLLRLLN-G316 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGDSLSWLLRLLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 212 - protein, 340 aa, Artificial Sequence
  Description of Artificial Sequence: Synthetic anti-hHER2-HC-G316-GDSLSWLLRLLN-K317 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGGDSLSWLLRLLNKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 213 - protein, 340 aa, Artificial Sequence
  Description of Artificial Sequence: Synthetic anti-hHER2-HC-K317-GDSLSWLLRLLN-E318 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKGDSLSWLLRLLNEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 214 - protein, 340 aa, Artificial Sequence
  Description of Artificial Sequence: Synthetic anti-hHER2-HC-K326-GDSLSWLLRLLN-A327 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKGDSLSWLLRLLNALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 215 - protein, 340 aa, Artificial Sequence
  Description of Artificial Sequence: Synthetic anti-hHER2-HC-A327-GDSLSWLLRLLN-L328 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAGDSLSWLLRLLNLPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 216 - protein, 340 aa, Artificial Sequence
  Description of Artificial Sequence: Synthetic anti-hHER2-HC-L328-GDSLSWLLRLLN-P329 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGDSLSWLLRLLNPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 217 - protein, 340 aa, Artificial Sequence
  Description of Artificial Sequence: Synthetic anti-hHER2-HC-P329-GDSLSWLLRLLN-A330 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPGDSLSWLLRLLNAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 218 - protein, 340 aa, Artificial Sequence
  Description of Artificial Sequence: Synthetic anti-hHER2-HC-A330-GDSLSWLLRLLN-P331 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAGDSLSWLLRLLNPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 219 - protein, 340 aa, Artificial Sequence
  Description of Artificial Sequence: Synthetic anti-hHER2-HC-A339-GDSLSWLLRLLN-K340 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAGDSLSWLLRLLNKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 220 - protein, 340 aa, Artificial Sequence
  Description of Artificial Sequence: Synthetic anti-hHER2-HC-K340-GDSLSWLLRLLN-G341 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGDSLSWLLRLLNGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 221 - protein, 340 aa, Artificial Sequence
  Description of Artificial Sequence: Synthetic anti-hHER2-HC-G341-GDSLSWLLRLLN-Q342 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGGDSLSWLLRLLNQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 222 - protein, 340 aa, Artificial Sequence
  Description of Artificial Sequence: Synthetic anti-hHER2-HC-Q342-GDSLSWLLRLLN-P343 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQGDSLSWLLRLLNPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 223 - protein, 340 aa, Artificial Sequence
  Description of Artificial Sequence: Synthetic anti-hHER2-HC-P343-GDSLSWLLRLLN-R344 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPGDSLSWLLRLLNREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 224 - protein, 340 aa, Artificial Sequence
  Description of Artificial Sequence: Synthetic anti-hHER2-HC-R344-GDSLSWLLRLLN-E345 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRGDSLSWLLRLLNEPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 225 - protein, 340 aa, Artificial Sequence
  Description of Artificial Sequence: Synthetic anti-hHER2-HC-R355-GDSLSWLLRLLN-E356 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRGDSLSWLLRLLNEEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 226 - protein, 340 aa, Artificial Sequence
  Description of Artificial Sequence: Synthetic anti-hHER2-HC-E356-GDSLSWLLRLLN-E357 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREGDSLSWLLRLLNEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 227 - protein, 340 aa, Artificial Sequence
  Description of Artificial Sequence: Synthetic anti-hHER2-HC-E357-GDSLSWLLRLLN-M358 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEGDSLSWLLRLLNMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 228 - protein, 340 aa, Artificial Sequence
  Description of Artificial Sequence: Synthetic anti-hHER2-HC-M358-GDSLSWLLRLLN-T359 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMGDSLSWLLRLLNTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 229 - protein, 340 aa, Artificial Sequence
  Description of Artificial Sequence: Synthetic anti-hHER2-HC-K360-GDSLSWLLRLLN-N361 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKGDSLSWLLRLLNNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 230 - protein, 340 aa, Artificial Sequence
  Description of Artificial Sequence: Synthetic anti-hHER2-HC-N384-GDSLSWLLRLLN-G385 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGDSLSWLLRLLNGQPENNYKTTPPVLDSDGSFFLYSKLTVDKSRWQQGNVFSCSVMHEALHNHYTQKSLSLSPG

SEQ ID NO: 231 - protein, 340 aa, Artificial Sequence
  Description of Artificial Sequence: Synthetic anti-hHER2-HC-N389-GDSLSWLLRLLN-N390 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENGDSLSWLLRLLNNYKTTPPVLDSDGSFFLYSKLTVDKSRWQQGNVFSCSVMHEALHNHYTQKSLSLSPG

SEQ ID NO: 232 - protein, 340 aa, Artificial Sequence
  Description of Artificial Sequence: Synthetic anti-hHER2-HC-T394-GDSLSWLLRLLN-P395 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTGDSLSWLLRLLNPPVLDSDGSFFLYSKLTVDKSRWQQGNVFSCSVMHEALHNHYTQKSLSLSPG

SEQ ID NO: 233 - protein, 340 aa, Artificial Sequence
  Description of Artificial Sequence: Synthetic anti-hHER2-HC-P395-GDSLSWLLRLLN-P396 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPGDSLSWLLRLLNPVLDSDGSFFLYSKLTVDKSRWQQGNVFSCSVMHEALHNHYTQKSLSLSPG

SEQ ID NO: 234 - protein, 340 aa, Artificial Sequence
  Description of Artificial Sequence: Synthetic anti-hHER2-HC-D399-GDSLSWLLRLLN-S400 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDGDSLSWLLRLLNSDGSFFLYSKLTVDKSRWQQGNVFSCSVMHEALHNHYTQKSLSLSPG

SEQ ID NO: 235 - protein, 340 aa, Artificial Sequence
  Description of Artificial Sequence: Synthetic anti-hHER2-HC-D401-GDSLSWLLRLLN-G402 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGDSLSWLLRLLNGSFFLYSKLTVDKSRWQQGNVFSCSVMHEALHNHYTQKSLSLSPG

SEQ ID NO: 236 - protein, 340 aa, Artificial Sequence
  Description of Artificial Sequence: Synthetic anti-hHER2-HC-S415-GDSLSWLLRLLN-R416 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSGDSLSWLLRLLNRWQQGNVFSCSVMHEALHNHYTQKSLSLSPG

SEQ ID NO: 237 - protein, 340 aa, Artificial Sequence
  Description of Artificial Sequence: Synthetic anti-hHER2-HC-R416-GDSLSWLLRLLN-W417 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRGDSLSWLLRLLNWQQGNVFSCSVMHEALHNHYTQKSLSLSPG

SEQ ID NO: 238 - protein, 340 aa, Artificial Sequence
  Description of Artificial Sequence: Synthetic anti-hHER2-HC-W417-GDSLSWLLRLLN-Q418 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWGDSLSWLLRLLNQQGNVFSCSVMHEALHNHYTQKSLSLSPG

SEQ ID NO: 239 - protein, 340 aa, Artificial Sequence
  Description of Artificial Sequence: Synthetic anti-hHER2-HC-Q418-GDSLSWLLRLLN-Q419 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQGDSLSWLLRLLNQGNVFSCSVMHEALHNHYTQKSLSLSPG

SEQ ID NO: 240 - protein, 340 aa, Artificial Sequence
  Description of Artificial Sequence: Synthetic anti-hHER2-HC-Q419-GDSLSWLLRLLN-G420 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGDSLSWLLRLLNGNVFSCSVMHEALHNHYTQKSLSLSPG

SEQ ID NO: 241 - protein, 340 aa, Artificial Sequence
  Description of Artificial Sequence: Synthetic anti-hHER2-HC-G420-GDSLSWLLRLLN-N421 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGGDSLSWLLRLLNNVFSCSVMHEALHNHYTQKSLSLSPG

SEQ ID NO: 242 - protein, 340 aa, Artificial Sequence
  Description of Artificial Sequence: Synthetic anti-hHER2-HC-N421-GDSLSWLLRLLN-V422 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNGDSLSWLLRLLNVFSCSVMHEALHNHYTQKSLSLSPG

SEQ ID NO: 243 - protein, 340 aa, Artificial Sequence
  Description of Artificial Sequence: Synthetic anti-hHER2-HC-H433-GDSLSWLLRLLN-N434 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHGDSLSWLLRLLNNHYTQKSLSLSPG

SEQ ID NO: 244 - protein, 340 aa, Artificial Sequence
  Description of Artificial Sequence: Synthetic anti-hHER2-HC-N434-GDSLSWLLRLLN-H435 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNGDSLSWLLRLLNHYTQKSLSLSPG

SEQ ID NO: 245 - protein, 340 aa, Artificial Sequence
  Description of Artificial Sequence: Synthetic anti-hHER2-HC-S442-GDSLSWLLRLLN-L443 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSGDSLSWLLRLLNLSPG

SEQ ID NO: 246 - protein, 340 aa, Artificial Sequence
  Description of Artificial Sequence: Synthetic anti-hHER2-HC-L443-GDSLSWLLRLLN-S444 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLGDSLSWLLRLLNSPG

SEQ ID NO: 247 - protein, 340 aa, Artificial Sequence
  Description of Artificial Sequence: Synthetic anti-hHER2-HC-S444-GDSLSWLLRLLN-P445 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSGDSLSWLLRLLNPG

SEQ ID NO: 248 - protein, 340 aa, Artificial Sequence
  Description of Artificial Sequence: Synthetic anti-hHER2-HC-P445-GDSLSWLLRLLN-G446 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGDSLSWLLRLLNG

SEQ ID NO: 249 - protein, 339 aa, Artificial Sequence
  Description of Artificial Sequence: Synthetic anti-hHER2-HC-A118-DSLEFIASKLA-S119 polypeptide
DSLEFIASKLASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 250 - protein, 339 aa, Artificial Sequence
  Description of Artificial Sequence: Synthetic anti-hHER2-HC-S119-DSLEFIASKLA-T120 polypeptide
SDSLEFIASKLATKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 251 - protein, 339 aa, Artificial Sequence
  Description of Artificial Sequence: Synthetic anti-hHER2-HC-T120-DSLEFIASKLA-K121 polypeptide
STDSLEFIASKLAKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 252 - protein, 339 aa, Artificial Sequence
  Description of Artificial Sequence: Synthetic anti-hHER2-HC-S131-DSLEFIASKLA-S132 polypeptide
STKGPSVFPLAPSDSLEFIASKLASKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 253 - protein, 339 aa, Artificial Sequence
  Description of Artificial Sequence: Synthetic anti-hHER2-HC-S132-DSLEFIASKLA-K133 polypeptide
STKGPSVFPLAPSSDSLEFIASKLAKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 254 - protein, 339 aa, Artificial Sequence
  Description of Artificial Sequence: Synthetic anti-hHER2-HC-K133-DSLEFIASKLA-S134 polypeptide
STKGPSVFPLAPSSKDSLEFIASKLASTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 255 - protein, 339 aa, Artificial Sequence
  Description of Artificial Sequence: Synthetic anti-hHER2-HC-S134-DSLEFIASKLA-T135 polypeptide
STKGPSVFPLAPSSKSDSLEFIASKLATSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 256 - protein, 339 aa, Artificial Sequence
  Description of Artificial Sequence: Synthetic anti-hHER2-HC-T135-DSLEFIASKLA-S136 polypeptide
STKGPSVFPLAPSSKSTDSLEFIASKLASGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 257 - protein, 339 aa, Artificial Sequence
  Description of Artificial Sequence: Synthetic anti-hHER2-HC-S136-DSLEFIASKLA-G137 polypeptide
STKGPSVFPLAPSSKSTSDSLEFIASKLAGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 258 - protein, 339 aa, Artificial Sequence
  Description of Artificial Sequence: Synthetic anti-hHER2-HC-G137-DSLEFIASKLA-G138 polypeptide
STKGPSVFPLAPSSKSTSGDSLEFIASKLAGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 259 - protein, 339 aa, Artificial Sequence
  Description of Artificial Sequence: Synthetic anti-hHER2-HC-G138-DSLEFIASKLA-T139 polypeptide
STKGPSVFPLAPSSKSTSGGDSLEFIASKLATAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 260 - protein, 339 aa, Artificial Sequence
  Description of Artificial Sequence: Synthetic anti-hHER2-HC-E152-DSLEFIASKLA-P153 polypeptide
STKGPSVFPLAPSSKSTSGGTAALGCLVKDYFPEDSLEFIASKLAPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 261 - protein, 339 aa, Artificial Sequence
  Description of Artificial Sequence: Synthetic anti-hHER2-HC-P153-DSLEFIASKLA-V154 polypeptide
STKGPSVFPLAPSSKSTSGGTAALGCLVKDYFPEPDSLEFIASKLAVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 262 - protein, 339 aa, Artificial Sequence
  Description of Artificial Sequence: Synthetic anti-hHER2-HC-N159-DSLEFIASKLA-S160 polypeptide
STKGPSVFPLAPSSKSTSGGTAALGCLVKDYFPEPVTVSWNDSLEFIASKLASGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 263 - protein, 339 aa, Artificial Sequence
  Description of Artificial Sequence: Synthetic anti-hHER2-HC-S160-DSLEFIASKLA-G161 polypeptide
STKGPSVFPLAPSSKSTSGGTAALGCLVKDYFPEPVTVSWNSDSLEFIASKLAGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 264 - protein, 339 aa, Artificial Sequence
  Description of Artificial Sequence: Synthetic anti-hHER2-HC-G161-DSLEFIASKLA-A162 polypeptide
STKGPSVFPLAPSSKSTSGGTAALGCLVKDYFPEPVTVSWNSGDSLEFIASKLAALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 265 - protein, 339 aa, Artificial Sequence
  Description of Artificial Sequence: Synthetic anti-hHER2-HC-A162-DSLEFIASKLA-L163 polypeptide
STKGPSVFPLAPSSKSTSGGTAALGCLVKDYFPEPVTVSWNSGADSLEFIASKLALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 266 - protein, 339 aa, Artificial Sequence
  Description of Artificial Sequence: Synthetic anti-hHER2-HC-L163-DSLEFIASKLA-T164 polypeptide
STKGPSVFPLAPSSKSTSGGTAALGCLVKDYFPEPVTVSWNSGALDSLEFIASKLATSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 267 - protein, 339 aa, Artificial Sequence
  Description of Artificial Sequence: Synthetic anti-hHER2-HC-T164-DSLEFIASKLA-S165 polypeptide
STKGPSVFPLAPSSKSTSGGTAALGCLVKDYFPEPVTVSWNSGALTDSLEFIASKLASGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 268 - protein, 339 aa, Artificial Sequence
  Description of Artificial Sequence: Synthetic anti-hHER2-HC-S165-DSLEFIASKLA-G166 polypeptide
STKGPSVFPLAPSSKSTSGGTAALGCLVKDYFPEPVTVSWNSGALTSDSLEFIASKLAGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 269 - protein, 339 aa, Artificial Sequence
  Description of Artificial Sequence: Synthetic anti-hHER2-HC-P171-DSLEFIASKLA-A172 polypeptide
STKGPSVFPLAPSSKSTSGGTAALGCLVKDYFPEPVTVSWNSGALTSGVHTFPDSLEFIASKLAAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 270 - protein, 339 aa, Artificial Sequence
  Description of Artificial Sequence: Synthetic anti-hHER2-HC-S176-DSLEFIASKLA-S177 polypeptide
STKGPSVFPLAPSSKSTSGGTAALGCLVKDYFPEPVTVSWNSGALTSGVHTFPAVLQSDSLEFIASKLASGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 271 - protein, 339 aa, Artificial Sequence
  Description of Artificial Sequence: Synthetic anti-hHER2-HC-S177-DSLEFIASKLA-G178 polypeptide
STKGPSVFPLAPSSKSTSGGTAALGCLVKDYFPEPVTVSWNSGALTSGVHTFPAVLQSSDSLEFIASKLAGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 272 - protein, 339 aa, Artificial Sequence
  Description of Artificial Sequence: Synthetic anti-hHER2-HC-P189-DSLEFIASKLA-S190 polypeptide
STKGPSVFPLAPSSKSTSGGTAALGCLVKDYFPEPVTVSWNSGALTSGVHTFPAVLQSSGLYSLSSVVTVPDSLEFIASKLASSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 273 - protein, 339 aa, Artificial Sequence
  Description of Artificial Sequence: Synthetic anti-hHER2-HC-S190-DSLEFIASKLA-S191 polypeptide
STKGPSVFPLAPSSKSTSGGTAALGCLVKDYFPEPVTVSWNSGALTSGVHTFPAVLQSSGLYSLSSVVTVPSDSLEFIASKLASSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 274 - protein, 339 aa, Artificial Sequence
  Description of Artificial Sequence: Synthetic anti-hHER2-HC-S191-DSLEFIASKLA-S192 polypeptide
STKGPSVFPLAPSSKSTSGGTAALGCLVKDYFPEPVTVSWNSGALTSGVHTFPAVLQSSGLYSLSSVVTVPSSDSLEFIASKLASLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 275 - protein, 339 aa, Artificial Sequence
  Description of Artificial Sequence: Synthetic anti-hHER2-HC-S192-DSLEFIASKLA-L193 polypeptide
STKGPSVFPLAPSSKSTSGGTAALGCLVKDYFPEPVTVSWNSGALTSGVHTFPAVLQSSGLYSLSSVVTVPSSSDSLEFIASKLALGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 276 - protein, 339 aa, Artificial Sequence
  Description of Artificial Sequence: Synthetic anti-hHER2-HC-L193-DSLEFIASKLA-G194 polypeptide
STKGPSVFPLAPSSKSTSGGTAALGCLVKDYFPEPVTVSWNSGALTSGVHTFPAVLQSSGLYSLSSVVTVPSSSLDSLEFIASKLAGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 277 - protein, 339 aa, Artificial Sequence
  Description of Artificial Sequence: Synthetic anti-hHER2-HC-G194-DSLEFIASKLA-T195 polypeptide
STKGPSVFPLAPSSKSTSGGTAALGCLVKDYFPEPVTVSWNSGALTSGVHTFPAVLQSSGLYSLSSVVTVPSSSLGDSLEFIASKLATQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 278 - protein, 339 aa, Artificial Sequence
  Description of Artificial Sequence: Synthetic anti-hHER2-HC-T195-DSLEFIASKLA-Q196 polypeptide
STKGPSVFPLAPSSKSTSGGTAALGCLVKDYFPEPVTVSWNSGALTSGVHTFPAVLQSSGLYSLSSVVTVPSSSLGTDSLEFIASKLAQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 279 - protein, 339 aa, Artificial Sequence
  Description of Artificial Sequence: Synthetic anti-hHER2-HC-Q196-DSLEFIASKLA-T197 polypeptide
STKGPSVFPLAPSSKSTSGGTAALGCLVKDYFPEPVTVSWNSGALTSGVHTFPAVLQSSGLYSLSSVVTVPSSSLGTQDSLEFIASKLATYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 280 - protein, 339 aa, Artificial Sequence
  Description of Artificial Sequence: Synthetic anti-hHER2-HC-K205-DSLEFIASKLA-P206 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKDSLEFIASKLAPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 281 - protein, 339 aa, Artificial Sequence
  Description of Artificial Sequence: Synthetic anti-hHER2-HC-P206-DSLEFIASKLA-S207 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPDSLEFIASKLASNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 282 - protein, 339 aa, Artificial Sequence
  Description of Artificial Sequence: Synthetic anti-hHER2-HC-S207-DSLEFIASKLA-N208 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSDSLEFIASKLANTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 283 - protein, 339 aa, Artificial Sequence
  Description of Artificial Sequence: Synthetic anti-hHER2-HC-P230-DSLEFIASKLA-A231 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPDSLEFIASKLAAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 284 - protein, 339 aa, Artificial Sequence
  Description of Artificial Sequence: Synthetic anti-hHER2-HC-A231-DSLEFIASKLA-P232 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPADSLEFIASKLAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 285 - protein, 339 aa, Artificial Sequence
  Description of Artificial Sequence: Synthetic anti-hHER2-HC-P232-DSLEFIASKLA-E233 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPDSLEFIASKLAELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 286 - protein, 339 aa, Artificial Sequence
  Description of Artificial Sequence: Synthetic anti-hHER2-HC-E233-DSLEFIASKLA-L234 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEDSLEFIASKLALLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 287 - protein, 339 aa, Artificial Sequence
  Description of Artificial Sequence: Synthetic anti-hHER2-HC-L234-DSLEFIASKLA-L235 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELDSLEFIASKLALGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 288 - protein, 339 aa, Artificial Sequence
  Description of Artificial Sequence: Synthetic anti-hHER2-HC-L235-DSLEFIASKLA-G236 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLDSLEFIASKLAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 289 - protein, 339 aa, Artificial Sequence
  Description of Artificial Sequence: Synthetic anti-hHER2-HC-G236-DSLEFIASKLA-G237 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGDSLEFIASKLAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 290 - protein, 339 aa, Artificial Sequence
  Description of Artificial Sequence: Synthetic anti-hHER2-HC-P244-DSLEFIASKLA-P245 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPDSLEFIASKLAPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 291 - protein, 339 aa, Artificial Sequence
  Description of Artificial Sequence: Synthetic anti-hHER2-HC-P245-DSLEFIASKLA-K246 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPDSLEFIASKLAKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 292 - protein, 339 aa, Artificial Sequence
  Description of Artificial Sequence: Synthetic anti-hHER2-HC-I253-DSLEFIASKLA-S254 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMIDSLEFIASKLASRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 293 - protein, 339 aa, Artificial Sequence
  Description of Artificial Sequence: Synthetic anti-hHER2-HC-S254-DSLEFIASKLA-R255 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISDSLEFIASKLARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 294 - protein, 339 aa, Artificial Sequence
  Description of Artificial Sequence: Synthetic anti-hHER2-HC-R255-DSLEFIASKLA-T256 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDSLEFIASKLATPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 295 - protein, 339 aa, Artificial Sequence
  Description of Artificial Sequence: Synthetic anti-hHER2-HC-T256-DSLEFIASKLA-P257 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTDSLEFIASKLAPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 296 - protein, 339 aa, Artificial Sequence
  Description of Artificial Sequence: Synthetic anti-hHER2-HC-P257-DSLEFIASKLA-E258 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPDSLEFIASKLAEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 297 - protein, 339 aa, Artificial Sequence
  Description of Artificial Sequence: Synthetic anti-hHER2-HC-S267-DSLEFIASKLA-H268 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSDSLEFIASKLAHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 298 - protein, 339 aa, Artificial Sequence
  Description of Artificial Sequence: Synthetic anti-hHER2-HC-H268-DSLEFIASKLA-E269 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHDSLEFIASKLAEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 299 - protein, 339 aa, Artificial Sequence
  Description of Artificial Sequence: Synthetic anti-hHER2-HC-E269-DSLEFIASKLA-D270 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDSLEFIASKLADPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 300 - protein, 339 aa, Artificial Sequence
  Description of Artificial Sequence: Synthetic anti-hHER2-HC-D270-DSLEFIASKLA-P271 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDDSLEFIASKLAPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 301 - protein, 339 aa, Artificial Sequence
  Description of Artificial Sequence: Synthetic anti-hHER2-HC-P271-DSLEFIASKLA-E272 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPDSLEFIASKLAEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 302 - protein, 339 aa, Artificial Sequence
  Description of Artificial Sequence: Synthetic anti-hHER2-HC-D280-DSLEFIASKLA-G281 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDDSLEFIASKLAGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 303 - protein, 339 aa, Artificial Sequence
  Description of Artificial Sequence: Synthetic anti-hHER2-HC-H285-DSLEFIASKLA-N286 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHDSLEFIASKLANAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 304 - protein, 339 aa, Artificial Sequence
  Description of Artificial Sequence: Synthetic anti-hHER2-HC-N286-DSLEFIASKLA-A287 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNDSLEFIASKLAAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 305 - protein, 339 aa, Artificial Sequence
  Description of Artificial Sequence: Synthetic anti-hHER2-HC-P291-DSLEFIASKLA-R292 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPDSLEFIASKLAREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 306 - protein, 339 aa, Artificial Sequence
  Description of Artificial Sequence: Synthetic anti-hHER2-HC-T307-DSLEFIASKLA-V308 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTDSLEFIASKLAVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 307 - protein, 339 aa, Artificial Sequence
  Description of Artificial Sequence: Synthetic anti-hHER2-HC-V308-DSLEFIASKLA-L309 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDSLEFIASKLALHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 308 - protein, 339 aa, Artificial Sequence
  Description of Artificial Sequence: Synthetic anti-hHER2-HC-L309-DSLEFIASKLA-H310 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLDSLEFIASKLAHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 309 - protein, 339 aa, Artificial Sequence
  Description of Artificial Sequence: Synthetic anti-hHER2-HC-H310-DSLEFIASKLA-Q311 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHDSLEFIASKLAQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 310 - protein, 339 aa, Artificial Sequence
  Description of Artificial Sequence: Synthetic anti-hHER2-HC-N315-DSLEFIASKLA-G316 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNDSLEFIASKLAGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 311 - protein, 339 aa, Artificial Sequence
  Description of Artificial Sequence: Synthetic anti-hHER2-HC-G316-DSLEFIASKLA-K317 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGDSLEFIASKLAKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 312 - protein, 339 aa, Artificial Sequence
  Description of Artificial Sequence: Synthetic anti-hHER2-HC-K317-DSLEFIASKLA-E318 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKDSLEFIASKLAEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 313 - protein, 339 aa, Artificial Sequence
  Description of Artificial Sequence: Synthetic anti-hHER2-HC-K326-DSLEFIASKLA-A327 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKDSLEFIASKLAALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 314 - protein, 339 aa, Artificial Sequence
  Description of Artificial Sequence: Synthetic anti-hHER2-HC-A327-DSLEFIASKLA-L328 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKADSLEFIASKLALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 315 - protein, 339 aa, Artificial Sequence
  Description of Artificial Sequence: Synthetic anti-hHER2-HC-L328-DSLEFIASKLA-P329 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALDSLEFIASKLAPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 316 - protein, 339 aa, Artificial Sequence
  Description of Artificial Sequence: Synthetic anti-hHER2-HC-P329-DSLEFIASKLA-A330 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPDSLEFIASKLAAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 317 - protein, 339 aa, Artificial Sequence
  Description of Artificial Sequence: Synthetic anti-hHER2-HC-A330-DSLEFIASKLA-P331 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPADSLEFIASKLAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 318 - protein, 339 aa, Artificial Sequence
  Description of Artificial Sequence: Synthetic anti-hHER2-HC-A339-DSLEFIASKLA-K340 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKADSLEFIASKLAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 319 - protein, 339 aa, Artificial Sequence
  Description of Artificial Sequence: Synthetic anti-hHER2-HC-K340-DSLEFIASKLA-G341 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKDSLEFIASKLAGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 320 - protein, 339 aa, Artificial Sequence
  Description of Artificial Sequence: Synthetic anti-hHER2-HC-G341-DSLEFIASKLA-Q342 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGDSLEFIASKLAQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 321 - protein, 339 aa, Artificial Sequence
  Description of Artificial Sequence: Synthetic anti-hHER2-HC-Q342-DSLEFIASKLA-P343 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQDSLEFIASKLAPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 322 - protein, 339 aa, Artificial Sequence
  Description of Artificial Sequence: Synthetic anti-hHER2-HC-P343-DSLEFIASKLA-R344 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPDSLEFIASKLAREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 323 - protein, 339 aa, Artificial Sequence
  Description of Artificial Sequence: Synthetic anti-hHER2-HC-R344-DSLEFIASKLA-E345 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRDSLEFIASKLAEPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 324 - protein, 339 aa, Artificial Sequence
  Description of Artificial Sequence: Synthetic anti-hHER2-HC-R355-DSLEFIASKLA-E356 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDSLEFIASKLAEEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 325 - protein, 339 aa, Artificial Sequence
  Description of Artificial Sequence: Synthetic anti-hHER2-HC-E356-DSLEFIASKLA-E357 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREDSLEFIASKLAEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 326 - protein, 339 aa, Artificial Sequence
  Description of Artificial Sequence: Synthetic anti-hHER2-HC-E357-DSLEFIASKLA-M358 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEDSLEFIASKLAMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 327 - protein, 339 aa, Artificial Sequence
  Description of Artificial Sequence: Synthetic anti-hHER2-HC-M358-DSLEFIASKLA-T359 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMDSLEFIASKLATKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 328 - protein, 339 aa, Artificial Sequence
  Description of Artificial Sequence: Synthetic anti-hHER2-HC-K360-DSLEFIASKLA-N361 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKDSLEFIASKLANQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 329 - protein, 339 aa, Artificial Sequence
  Description of Artificial Sequence: Synthetic anti-hHER2-HC-N384-DSLEFIASKLA-G385 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNDSLEFIASKLAGQPENNYKTTPPVLDSDGSFFLYSKLTVDKSRWQQGNVFSCSVMHEALHNHYTQKSLSLSPG

SEQ ID NO: 330 - protein, 339 aa, Artificial Sequence
  Description of Artificial Sequence: Synthetic anti-hHER2-HC-N389-DSLEFIASKLA-N390 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENDSLEFIASKLANYKTTPPVLDSDGSFFLYSKLTVDKSRWQQGNVFSCSVMHEALHNHYTQKSLSLSPG

SEQ ID NO: 331 - protein, 339 aa, Artificial Sequence
  Description of Artificial Sequence: Synthetic anti-hHER2-HC-T394-DSLEFIASKLA-P395 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTDSLEFIASKLAPPVLDSDGSFFLYSKLTVDKSRWQQGNVFSCSVMHEALHNHYTQKSLSLSPG

SEQ ID NO: 332 - protein, 339 aa, Artificial Sequence
  Description of Artificial Sequence: Synthetic anti-hHER2-HC-P395-DSLEFIASKLA-P396 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPDSLEFIASKLAPVLDSDGSFFLYSKLTVDKSRWQQGNVFSCSVMHEALHNHYTQKSLSLSPG

SEQ ID NO: 333 - protein, 339 aa, Artificial Sequence
  Description of Artificial Sequence: Synthetic anti-hHER2-HC-D399-DSLEFIASKLA-S400 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDDSLEFIASKLASDGSFFLYSKLTVDKSRWQQGNVFSCSVMHEALHNHYTQKSLSLSPG

SEQ ID NO: 334 - protein, 339 aa, Artificial Sequence
  Description of Artificial Sequence: Synthetic anti-hHER2-HC-S400-DSLEFIASKLA-D401 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDSLEFIASKLADGSFFLYSKLTVDKSRWQQGNVFSCSVMHEALHNHYTQKSLSLSPG

SEQ ID NO: 335 - protein, 339 aa, Artificial Sequence
  Description of Artificial Sequence: Synthetic anti-hHER2-HC-D401-DSLEFIASKLA-G402 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDDSLEFIASKLAGSFFLYSKLTVDKSRWQQGNVFSCSVMHEALHNHYTQKSLSLSPG

SEQ ID NO: 336 - protein, 339 aa, Artificial Sequence
  Description of Artificial Sequence: Synthetic anti-hHER2-HC-S415-DSLEFIASKLA-R416 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSDSLEFIASKLARWQQGNVFSCSVMHEALHNHYTQKSLSLSPG

SEQ ID NO: 337 - protein, 339 aa, Artificial Sequence
  Description of Artificial Sequence: Synthetic anti-hHER2-HC-R416-DSLEFIASKLA-W417 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRDSLEFIASKLAWQQGNVFSCSVMHEALHNHYTQKSLSLSPG

SEQ ID NO: 338 - protein, 339 aa, Artificial Sequence
  Description of Artificial Sequence: Synthetic anti-hHER2-HC-W417-DSLEFIASKLA-Q418 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWDSLEFIASKLAQQGNVFSCSVMHEALHNHYTQKSLSLSPG

SEQ ID NO: 339 - protein, 339 aa, Artificial Sequence
  Description of Artificial Sequence: Synthetic anti-hHER2-HC-Q418-DSLEFIASKLA-Q419 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQDSLEFIASKLAQGNVFSCSVMHEALHNHYTQKSLSLSPG

SEQ ID NO: 340 - protein, 339 aa, Artificial Sequence
  Description of Artificial Sequence: Synthetic anti-hHER2-HC-Q419-DSLEFIASKLA-G420 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQDSLEFIASKLAGNVFSCSVMHEALHNHYTQKSLSLSPG

SEQ ID NO: 341 - protein, 339 aa, Artificial Sequence
  Description of Artificial Sequence: Synthetic anti-hHER2-HC-G420-DSLEFIASKLA-N421 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGDSLEFIASKLANVFSCSVMHEALHNHYTQKSLSLSPG

SEQ ID NO: 342 - protein, 339 aa, Artificial Sequence
  Description of Artificial Sequence: Synthetic anti-hHER2-HC-N421-DSLEFIASKLA-V422 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNDSLEFIASKLAVFSCSVMHEALHNHYTQKSLSLSPG

SEQ ID NO: 343 - protein, 339 aa, Artificial Sequence
  Description of Artificial Sequence: Synthetic anti-hHER2-HC-H433-DSLEFIASKLA-N434 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHDSLEFIASKLANHYTQKSLSLSPG

SEQ ID NO: 344 - protein, 339 aa, Artificial Sequence
  Description of Artificial Sequence: Synthetic anti-hHER2-HC-N434-DSLEFIASKLA-H435 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNDSLEFIASKLAHYTQKSLSLSPG

SEQ ID NO: 345 - protein, 339 aa, Artificial Sequence
  Description of Artificial Sequence: Synthetic anti-hHER2-HC-S442-DSLEFIASKLA-L443 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSDSLEFIASKLALSPG

SEQ ID NO: 346 - protein, 339 aa, Artificial Sequence
  Description of Artificial Sequence: Synthetic anti-hHER2-HC-L443-DSLEFIASKLA-S444 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLDSLEFIASKLASPG

SEQ ID NO: 347 - protein, 339 aa, Artificial Sequence
  Description of Artificial Sequence: Synthetic anti-hHER2-HC-S444-DSLEFIASKLA-P445 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSDSLEFIASKLAPG

SEQ ID NO: 348 - protein, 339 aa, Artificial Sequence
  Description of Artificial Sequence: Synthetic anti-hHER2-HC-P445-DSLEFIASKLA-G446 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPDSLEFIASKLAG

SEQ ID NO: 349 - protein, 339 aa, Artificial Sequence
  Description of Artificial Sequence: Synthetic anti-hHER2-HC-G446-DSLEFIASKLA-K447 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGDSLEFIASKLA

SEQ ID NO: 350 - protein, 237 aa, Bacillus subtilis
  Sfp enzyme (with TEV protease cleavage site)
MKIYGIYMDRPLSQEENERFMSFISPEKREKCRRFYHKEDAHRTLLGDVLVRSVISRQYQLDKSDIRFSTQEYGKPCIPDLPDAHFNISHSGRWVICAFDSQPIGIDIEKTKPISLEIAKRFFSKTEYSDLLAKDKDEQTDYFYHLWSMKESFIKQEGKGLSLPLDSFSVRLHQDGQVSIELPDSHSPCYIKTYEVDPGYKMAVCAAHPDFPEDITMVSYEELLENLYFQGHHHHHH

SEQ ID NO: 351 - protein, 230 aa, Bacillus subtilis
  Sfp enzyme (without TEV protease cleavage site)
MKIYGIYMDRPLSQEENERFMSFISPEKREKCRRFYHKEDAHRTLLGDVLVRSVISRQYQLDKSDIRFSTQEYGKPCIPDLPDAHFNISHSGRWVICAFDSQPIGIDIEKTKPISLEIAKRFFSKTEYSDLLAKDKDEQTDYFYHLWSMKESFIKQEGKGLSLPLDSFSVRLHQDGQVSIELPDSHSPCYIKTYEVDPGYKMAVCAAHPDFPEDITMVSYEELLHHHHHH

SEQ ID NO: 352 - protein, 237 aa, Bacillus subtilis
  Sfp mutant R4-4 (with TEV protease cleavage site)
MKIYGIYMDRPLSQEENERFMSFISPEEREKCRRFYHKEDAHRELLGDVLVRSVISRQYQLDKSDIRFSTQEYGKPYIPDLPDAHFNISHSGRWVICAFDSQPIGIDIEKTKPISLEIAKRFFSKTEYSDLLAKDKDEQTDYFYHLWSMKESFIKQEGKGLSLPLDSFSVRLHQDGQVSIELPDSHSPCYIKTYEVDPGYKMAVCAAHPDFPEDITMVSYEELLENLYFQGHHHHHH

SEQ ID NO: 353 - protein, 132 aa, Escherichia coli
  AcpS enzyme
MAILGLGTDIVEIARIEAVIARSGDRLARRVLSDNEWAIWKTHHQPVRFLAKRFAVKEAAAKAFGTGIRNGLAFNQFEVFNDELGKPRLRLWGEALKLAEKLGVANMHVTLADERHYACATVIIESHHHHHH

SEQ ID NO: 354 - protein, 180 aa, Thermotoga maritima
  PPTase
GSDKIHHHHHHMIVGVGIDVLEVERVPEKFAERILGESEKRLFLTRKRRREFIAGRFALKEAFFKALGTGLNGHSFTDVEFLESNGKPVLCVHKDFGFFNYAHVSLSHDRFAVALVVLEKRKGDIIVEGDESFLRKRFEVLERSVEGWEIETSLPPFTLKKLLESSGCRLVRYGNILIGE

SEQ ID NO: 355 - protein, 24 aa, Artificial Sequence
  Description of Artificial Sequence: Synthetic signal peptide for protein secretion
MKTFILLLWVLLLWVIFLLPGATA

SEQ ID NO: 356 - protein, 340 aa, Artificial Sequence
  Description of Artificial Sequence: Synthetic mAb2-HC-E388-GDSLDMLEWSLM-N389 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPEGDSLDMLEWSLMNNYKTTPPVLDSDGSFFLYSKLTVDKSRWQQGNVFSCSVMHEALHNHYTQKSLSLSPG

SEQ ID NO: 357 - protein, 340 aa, Artificial Sequence
  Description of Artificial Sequence: Synthetic anti-hHER2-HC-A118-GDSLDMLEWSLM-S119 polypeptide
GDSLDMLEWSLMSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 358 - protein, 340 aa, Artificial Sequence
  Description of Artificial Sequence: Synthetic anti-hHER2-HC-S119-GDSLDMLEWSLM-T120 polypeptide
SGDSLDMLEWSLMTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 359 - protein, 340 aa, Artificial Sequence
  Description of Artificial Sequence: Synthetic anti-hHER2-HC-T120-GDSLDMLEWSLM-K121 polypeptide
STGDSLDMLEWSLMKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 360 - protein, 340 aa, Artificial Sequence
  Description of Artificial Sequence: Synthetic anti-hHER2-HC-S131-GDSLDMLEWSLM-S132 polypeptide
STKGPSVFPLAPSGDSLDMLEWSLMSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 361 - protein, 340 aa, Artificial Sequence
  Description of Artificial Sequence: Synthetic anti-hHER2-HC-S132-GDSLDMLEWSLM-K133 polypeptide
STKGPSVFPLAPSSGDSLDMLEWSLMKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 362 - protein, 340 aa, Artificial Sequence
  Description of Artificial Sequence: Synthetic anti-hHER2-HC-K133-GDSLDMLEWSLM-S134 polypeptide
STKGPSVFPLAPSSKGDSLDMLEWSLMSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 363 - protein, 340 aa, Artificial Sequence
  Description of Artificial Sequence: Synthetic anti-hHER2-HC-S134-GDSLDMLEWSLM-T135 polypeptide
STKGPSVFPLAPSSKSGDSLDMLEWSLMTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 364 - protein, 340 aa, Artificial Sequence
  Description of Artificial Sequence: Synthetic anti-hHER2-HC-T135-GDSLDMLEWSLM-S136 polypeptide
STKGPSVFPLAPSSKSTGDSLDMLEWSLMSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 365 - protein, 340 aa, Artificial Sequence
  Description of Artificial Sequence: Synthetic anti-hHER2-HC-S136-GDSLDMLEWSLM-G137 polypeptide
STKGPSVFPLAPSSKSTSGDSLDMLEWSLMGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 366 - protein, 340 aa, Artificial Sequence
  Description of Artificial Sequence: Synthetic anti-hHER2-HC-G137-GDSLDMLEWSLM-G138 polypeptide
STKGPSVFPLAPSSKSTSGGDSLDMLEWSLMGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 367 - protein, 340 aa, Artificial Sequence
  Description of Artificial Sequence: Synthetic anti-hHER2-HC-G138-GDSLDMLEWSLM-T139 polypeptide
STKGPSVFPLAPSSKSTSGGGDSLDMLEWSLMTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 368 - protein, 340 aa, Artificial Sequence
  Description of Artificial Sequence: Synthetic anti-hHER2-HC-N159-GDSLDMLEWSLM-S160 polypeptide
STKGPSVFPLAPSSKSTSGGTAALGCLVKDYFPEPVTVSWNGDSLDMLEWSLMSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 369 - protein, 340 aa, Artificial Sequence
  Description of Artificial Sequence: Synthetic anti-hHER2-HC-S160-GDSLDMLEWSLM-G161 polypeptide
STKGPSVFPLAPSSKSTSGGTAALGCLVKDYFPEPVTVSWNSGDSLDMLEWSLMGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 370 - protein, 340 aa, Artificial Sequence
  Description of Artificial Sequence: Synthetic anti-hHER2-HC-G161-GDSLDMLEWSLM-A162 polypeptide
STKGPSVFPLAPSSKSTSGGTAALGCLVKDYFPEPVTVSWNSGGDSLDMLEWSLMALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 371 - protein, 340 aa, Artificial Sequence
  Description of Artificial Sequence: Synthetic anti-hHER2-HC-A162-GDSLDMLEWSLM-L163 polypeptide
STKGPSVFPLAPSSKSTSGGTAALGCLVKDYFPEPVTVSWNSGAGDSLDMLEWSLMLTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 372 - protein, 340 aa, Artificial Sequence
  Description of Artificial Sequence: Synthetic anti-hHER2-HC-L163-GDSLDMLEWSLM-T164 polypeptide
STKGPSVFPLAPSSKSTSGGTAALGCLVKDYFPEPVTVSWNSGALGDSLDMLEWSLMTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 373 - protein, 340 aa, Artificial Sequence
  Description of Artificial Sequence: Synthetic anti-hHER2-HC-T164-GDSLDMLEWSLM-S165 polypeptide
STKGPSVFPLAPSSKSTSGGTAALGCLVKDYFPEPVTVSWNSGALTGDSLDMLEWSLMSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 374 - protein, 340 aa, Artificial Sequence
  Description of Artificial Sequence: Synthetic anti-hHER2-HC-S165-GDSLDMLEWSLM-G166 polypeptide
STKGPSVFPLAPSSKSTSGGTAALGCLVKDYFPEPVTVSWNSGALTSGDSLDMLEWSLMGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 375 - protein, 340 aa, Artificial Sequence
  Description of Artificial Sequence: Synthetic anti-hHER2-HC-P189-GDSLDMLEWSLM-S190 polypeptide
STKGPSVFPLAPSSKSTSGGTAALGCLVKDYFPEPVTVSWNSGALTSGVHTFPAVLQSSGLYSLSSVVTVPGDSLDMLEWSLMSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 376 - protein, 340 aa, Artificial Sequence
  Description of Artificial Sequence: Synthetic anti-hHER2-HC-S190-GDSLDMLEWSLM-S191 polypeptide
STKGPSVFPLAPSSKSTSGGTAALGCLVKDYFPEPVTVSWNSGALTSGVHTFPAVLQSSGLYSLSSVVTVPSGDSLDMLEWSLMSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 377 - protein, 340 aa, Artificial Sequence
  Description of Artificial Sequence: Synthetic anti-hHER2-HC-S191-GDSLDMLEWSLM-S192 polypeptide
STKGPSVFPLAPSSKSTSGGTAALGCLVKDYFPEPVTVSWNSGALTSGVHTFPAVLQSSGLYSLSSVVTVPSSGDSLDMLEWSLMSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 378 - protein, 340 aa, Artificial Sequence
  Description of Artificial Sequence: Synthetic anti-hHER2-HC-S192-GDSLDMLEWSLM-L193 polypeptide
STKGPSVFPLAPSSKSTSGGTAALGCLVKDYFPEPVTVSWNSGALTSGVHTFPAVLQSSGLYSLSSVVTVPSSSGDSLDMLEWSLMLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 379 - protein, 341 aa, Artificial Sequence
  Description of Artificial Sequence: Synthetic anti-hHER2-HC-L193-GDSLDMLEWSLMN-G194 polypeptide
STKGPSVFPLAPSSKSTSGGTAALGCLVKDYFPEPVTVSWNSGALTSGVHTFPAVLQSSGLYSLSSVVTVPSSSLGDSLDMLEWSLMNGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 380 - protein, 341 aa, Artificial Sequence
  Description of Artificial Sequence: Synthetic anti-hHER2-HC-G194-GDSLDMLEWSLMN-T195 polypeptide
STKGPSVFPLAPSSKSTSGGTAALGCLVKDYFPEPVTVSWNSGALTSGVHTFPAVLQSSGLYSLSSVVTVPSSSLGGDSLDMLEWSLMNTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 381 - protein, 341 aa, Artificial Sequence
  Description of Artificial Sequence: Synthetic anti-hHER2-HC-T195-GDSLDMLEWSLMN-Q196 polypeptide
STKGPSVFPLAPSSKSTSGGTAALGCLVKDYFPEPVTVSWNSGALTSGVHTFPAVLQSSGLYSLSSVVTVPSSSLGTGDSLDMLEWSLMNQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 382 - protein, 341 aa, Artificial Sequence
  Description of Artificial Sequence: Synthetic anti-hHER2-HC-Q196-GDSLDMLEWSLMN-T197 polypeptide
STKGPSVFPLAPSSKSTSGGTAALGCLVKDYFPEPVTVSWNSGALTSGVHTFPAVLQSSGLYSLSSVVTVPSSSLGTQGDSLDMLEWSLMNTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 383 - protein, 118 aa, Artificial Sequence
  Description of Artificial Sequence: Synthetic anti-hHER2-LC-T109-GDSLDMLEWSLM-V110 polypeptide
TGDSLDMLEWSLMVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 384 - protein, 118 aa, Artificial Sequence
  Description of Artificial Sequence: Synthetic anti-hHER2-LC-V110-GDSLDMLEWSLM-A111 polypeptide
TVGDSLDMLEWSLMAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 385 - protein, 118 aa, Artificial Sequence
  Description of Artificial Sequence: Synthetic anti-hHER2-LC-A111-GDSLDMLEWSLM-A112 polypeptide
TVAGDSLDMLEWSLMAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 386 - protein, 340 aa, Artificial Sequence
  Description of Artificial Sequence: Synthetic anti-hHER2-HC-P445-GDSLDMLEWSLM-G446 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGDSLDMLEWSLMG

SEQ ID NO: 387 - protein, 340 aa, Artificial Sequence
  Description of Artificial Sequence: Synthetic anti-hHER2-HC-G446-GDSLDMLEWSLM-K447 polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGDSLDMLEWSLM

SEQ ID NO: 388 - protein, 226 aa, Artificial Sequence
  Description of Artificial Sequence: Synthetic anti-hHER2-LC-I2-GDSLDMLEWSLM-Q3 polypeptide
DIGDSLDMLEWSLMQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 389 - DNA, 48 bp, Artificial Sequence
  Description of Artificial Sequence: Synthetic primer
ctgagctggctgctgagactgctgaacacctccggcgtgcacaccttc

SEQ ID NO: 390 - DNA, 47 bp, Artificial Sequence
  Description of Artificial Sequence: Synthetic primer
tctcagcagccagctcaggctgtcgcccagggctccgctgttccagg

SEQ ID NO: 391 - DNA, 47 bp, Artificial Sequence
  Description of Artificial Sequence: Synthetic primer
ctgagctggctgctgagactgctgaactccggcgtgcacaccttccc

SEQ ID NO: 392 - DNA, 47 bp, Artificial Sequence
  Description of Artificial Sequence: Synthetic primer
tctcagcagccagctcaggctgtcgccggtcagggctccgctgttcc

SEQ ID NO: 393 - DNA, 46 bp, Artificial Sequence
  Description of Artificial Sequence: Synthetic primer
ctgagctggctgctgagactgctgaacggcgtgcacaccttccccg

SEQ ID NO: 394 - DNA, 46 bp, Artificial Sequence
  Description of Artificial Sequence: Synthetic primer
tctcagcagccagctcaggctgtcgccggaggtcagggctccgctg

SEQ ID NO: 395 - DNA, 46 bp, Artificial Sequence
  Description of Artificial Sequence: Synthetic primer
ctgagctggctgctgagactgctgaacgccgtgctgcagagcagcg

SEQ ID NO: 396 - DNA, 46 bp, Artificial Sequence
  Description of Artificial Sequence: Synthetic primer
tctcagcagccagctcaggctgtcgccggggaaggtgtgcacgccg

SEQ ID NO: 397 - DNA, 48 bp, Artificial Sequence
  Description of Artificial Sequence: Synthetic primer
ctgagctggctgctgagactgctgaacagcggcctgtacagcctgtcc

SEQ ID NO: 398 - DNA, 45 bp, Artificial Sequence
  Description of Artificial Sequence: Synthetic primer
tctcagcagccagctcaggctgtcgccgctctgcagcacggcggg

SEQ ID NO: 399 - DNA, 48 bp, Artificial Sequence
  Description of Artificial Sequence: Synthetic primer
ctgagctggctgctgagactgctgaacggcctgtacagcctgtccagc

SEQ ID NO: 400 - DNA, 46 bp, Artificial Sequence
  Description of Artificial Sequence: Synthetic primer
tctcagcagccagctcaggctgtcgccgctgctctgcagcacggcg

SEQ ID NO: 401 - DNA, 46 bp, Artificial Sequence
  Description of Artificial Sequence: Synthetic primer
ctgagctggctgctgagactgctgaacagcagcagcctgggcaccc

SEQ ID NO: 402 - DNA, 47 bp, Artificial Sequence
  Description of Artificial Sequence: Synthetic primer
tctcagcagccagctcaggctgtcgccgggcactgtcaccacgctgg

SEQ ID NO: 403 - DNA, 47 bp, Artificial Sequence
  Description of Artificial Sequence: Synthetic primer
ctgagctggctgctgagactgctgaacagcagcctgggcacccagac

SEQ ID NO: 404 - DNA, 47 bp, Artificial Sequence
  Description of Artificial Sequence: Synthetic primer
tctcagcagccagctcaggctgtcgccgctgggcactgtcaccacgc

SEQ ID NO: 405 - DNA, 48 bp, Artificial Sequence
  Description of Artificial Sequence: Synthetic primer
ctgagctggctgctgagactgctgaacagcctgggcacccagacctac

SEQ ID NO: 406 - DNA, 48 bp, Artificial Sequence
  Description of Artificial Sequence: Synthetic primer
tctcagcagccagctcaggctgtcgccgctgctgggcactgtcaccac

SEQ ID NO: 407 - DNA, 48 bp, Artificial Sequence
  Description of Artificial Sequence: Synthetic primer
ctgagctggctgctgagactgctgaacctgggcacccagacctacatc

SEQ ID NO: 408 - DNA, 48 bp, Artificial Sequence
  Description of Artificial Sequence: Synthetic primer
tctcagcagccagctcaggctgtcgccgctgctgctgggcactgtcac

SEQ ID NO: 409 - DNA, 48 bp, Artificial Sequence
  Description of Artificial Sequence: Synthetic primer
ctgagctggctgctgagactgctgaacggcacccagacctacatctgc

SEQ ID NO: 410 - DNA, 47 bp, Artificial Sequence
  Description of Artificial Sequence: Synthetic primer
tctcagcagccagctcaggctgtcgcccaggctgctgctgggcactg

SEQ ID NO: 411 - DNA, 51 bp, Artificial Sequence
  Description of Artificial Sequence: Synthetic primer
ctgagctggctgctgagactgctgaacacccagacctacatctgcaacgtg

SEQ ID NO: 412 - DNA, 45 bp, Artificial Sequence
  Description of Artificial Sequence: Synthetic primer
tctcagcagccagctcaggctgtcgccgcccaggctgctgctggg

SEQ ID NO: 413 - DNA, 51 bp, Artificial Sequence
  Description of Artificial Sequence: Synthetic primer
ctgagctggctgctgagactgctgaaccagacctacatctgcaacgtgaac

SEQ ID NO: 414 - DNA, 46 bp, Artificial Sequence
  Description of Artificial Sequence: Synthetic primer
tctcagcagccagctcaggctgtcgccggtgcccaggctgctgctg

SEQ ID NO: 415 - DNA, 51 bp, Artificial Sequence
  Description of Artificial Sequence: Synthetic primer
ctgagctggctgctgagactgctgaacacctacatctgcaacgtgaaccac

SEQ ID NO: 416 - DNA, 46 bp, Artificial Sequence
  Description of Artificial Sequence: Synthetic primer
tctcagcagccagctcaggctgtcgccctgggtgcccaggctgctg

SEQ ID NO: 417 - DNA, 48 bp, Artificial Sequence
  Description of Artificial Sequence: Synthetic primer
ctgagctggctgctgagactgctgaaccccagcaacaccaaggtggac

SEQ ID NO: 418 - DNA, 53 bp, Artificial Sequence
  Description of Artificial Sequence: Synthetic primer
tctcagcagccagctcaggctgtcgcccttgtggttcacgttgcagatgtagg

SEQ ID NO: 419 - DNA, 52 bp, Artificial Sequence
  Description of Artificial Sequence: Synthetic primer
ctgagctggctgctgagactgctgaacagcaacaccaaggtggacaagaaag

SEQ ID NO: 420 - DNA, 49 bp, Artificial Sequence
  Description of Artificial Sequence: Synthetic primer
tctcagcagccagctcaggctgtcgccgggcttgtggttcacgttgcag

SEQ ID NO: 421 - DNA, 52 bp, Artificial Sequence
  Description of Artificial Sequence: Synthetic primer
ctgagctggctgctgagactgctgaacaacaccaaggtggacaagaaagtgg

SEQ ID NO: 422 - DNA, 49 bp, Artificial Sequence
  Description of Artificial Sequence: Synthetic primer
tctcagcagccagctcaggctgtcgccgctgggcttgtggttcacgttg

SEQ ID NO: 423 - DNA, 45 bp, Artificial Sequence
  Description of Artificial Sequence: Synthetic primer
ctgagctggctgctgagactgctgaacgccccagagctgctgggc

SEQ ID NO: 424 - DNA, 46 bp, Artificial Sequence
  Description of Artificial Sequence: Synthetic primer
tctcagcagccagctcaggctgtcgcctgggcagggggggcaggtg

SEQ ID NO: 425 - DNA, 46 bp, Artificial Sequence
  Description of Artificial Sequence: Synthetic primer
ctgagctggctgctgagactgctgaacccagagctgctgggcggac

SEQ ID NO: 426 - DNA, 44 bp, Artificial Sequence
  Description of Artificial Sequence: Synthetic primer
tctcagcagccagctcaggctgtcgccggctgggcagggggggc

SEQ ID NO: 427 - DNA, 45 bp, Artificial Sequence
  Description of Artificial Sequence: Synthetic primer
ctgagctggctgctgagactgctgaacgagctgctgggcggaccc

SEQ ID NO: 428 - DNA, 45 bp, Artificial Sequence
  Description of Artificial Sequence: Synthetic primer
tctcagcagccagctcaggctgtcgcctggggctgggcagggggg

SEQ ID NO: 429 - DNA, 45 bp, Artificial Sequence
  Description of Artificial Sequence: Synthetic primer
ctgagctggctgctgagactgctgaacctgctgggcggaccctcc

SEQ ID NO: 430 - DNA, 45 bp, Artificial Sequence
  Description of Artificial Sequence: Synthetic primer
tctcagcagccagctcaggctgtcgccctctggggctgggcaggg

SEQ ID NO: 431 - DNA, 45 bp, Artificial Sequence
  Description of Artificial Sequence: Synthetic primer
ctgagctggctgctgagactgctgaacctgggcggaccctccgtg

SEQ ID NO: 432 - DNA, 46 bp, Artificial Sequence
  Description of Artificial Sequence: Synthetic primer
tctcagcagccagctcaggctgtcgcccagctctggggctgggcag

SEQ ID NO: 433 - DNA, 46 bp, Artificial Sequence
  Description of Artificial Sequence: Synthetic primer
ctgagctggctgctgagactgctgaacggcggaccctccgtgttcc

SEQ ID NO: 434 - DNA, 46 bp, Artificial Sequence
  Description of Artificial Sequence: Synthetic primer
tctcagcagccagctcaggctgtcgcccagcagctctggggctggg

SEQ ID NO: 435 - DNA, 49 bp, Artificial Sequence
  Description of Artificial Sequence: Synthetic primer
ctgagctggctgctgagactgctgaacggaccctccgtgttcctgttcc

SEQ ID NO: 436 - DNA, 45 bp, Artificial Sequence
  Description of Artificial Sequence: Synthetic primer
tctcagcagccagctcaggctgtcgccgcccagcagctctggggc

SEQ ID NO: 437 - DNA, 48 bp, Artificial Sequence
  Description of Artificial Sequence: Synthetic primer
ctgagctggctgctgagactgctgaaccccaagcccaaggacaccctg

SEQ ID NO: 438 - DNA, 48 bp, Artificial Sequence
  Description of Artificial Sequence: Synthetic primer
tctcagcagccagctcaggctgtcgccggggaacaggaacacggaggg

SEQ ID NO: 439 - DNA, 51 bp, Artificial Sequence
  Description of Artificial Sequence: Synthetic primer
ctgagctggctgctgagactgctgaacaagcccaaggacaccctgatgatc

SEQ ID NO: 440 - DNA, 47 bp, Artificial Sequence
  Description of Artificial Sequence: Synthetic primer
tctcagcagccagctcaggctgtcgccgggggggaacaggaacacgg

SEQ ID NO: 441 - DNA, 47 bp, Artificial Sequence
  Description of Artificial Sequence: Synthetic primer
ctgagctggctgctgagactgctgaacagcaggacccccgaggtgac

SEQ ID NO: 442 - DNA, 49 bp, Artificial Sequence
  Description of Artificial Sequence: Synthetic primer
tctcagcagccagctcaggctgtcgccgatcatcagggtgtccttgggc

SEQ ID NO: 443 - DNA, 47 bp, Artificial Sequence
  Description of Artificial Sequence: Synthetic primer
ctgagctggctgctgagactgctgaacaggacccccgaggtgacctg

SEQ ID NO: 444 - DNA, 50 bp, Artificial Sequence
  Description of Artificial Sequence: Synthetic primer
tctcagcagccagctcaggctgtcgccgctgatcatcagggtgtccttgg

SEQ ID NO: 445 - DNA, 46 bp, Artificial Sequence
  Description of Artificial Sequence: Synthetic primer
ctgagctggctgctgagactgctgaacacccccgaggtgacctgcg

SEQ ID NO: 446 - DNA, 49 bp, Artificial Sequence
  Description of Artificial Sequence: Synthetic primer
tctcagcagccagctcaggctgtcgcccctgctgatcatcagggtgtcc

SEQ ID NO: 447 - DNA, 46 bp, Artificial Sequence
  Description of Artificial Sequence: Synthetic primer
ctgagctggctgctgagactgctgaaccccgaggtgacctgcgtgg

SEQ ID NO: 448 - DNA, 49 bp, Artificial Sequence
  Description of Artificial Sequence: Synthetic primer
tctcagcagccagctcaggctgtcgccggtcctgctgatcatcagggtg

SEQ ID NO: 449 - DNA, 48 bp, Artificial Sequence
  Description of Artificial Sequence: Synthetic primer
ctgagctggctgctgagactgctgaacgaggtgacctgcgtggtggtg

SEQ ID NO: 450 - DNA, 48 bp, Artificial Sequence
  Description of Artificial Sequence: Synthetic primer
tctcagcagccagctcaggctgtcgccgggggtcctgctgatcatcag

SEQ ID NO: 451 - DNA, 51 bp, Artificial Sequence
  Description of Artificial Sequence: Synthetic primer
ctgagctggctgctgagactgctgaaccacgaggacccagaggtgaagttc

SEQ ID NO: 452 - DNA, 47 bp, Artificial Sequence
  Description of Artificial Sequence: Synthetic primer
tctcagcagccagctcaggctgtcgccgctcacgtccaccaccacgc

SEQ ID NO: 453 - DNA, 51 bp, Artificial Sequence
  Description of Artificial Sequence: Synthetic primer
ctgagctggctgctgagactgctgaacgaggacccagaggtgaagttcaac

SEQ ID NO: 454 - DNA, 48 bp, Artificial Sequence
  Description of Artificial Sequence: Synthetic primer
tctcagcagccagctcaggctgtcgccgtggctcacgtccaccaccac

SEQ ID NO: 455 - DNA, 51 bp, Artificial Sequence
  Description of Artificial Sequence: Synthetic primer
ctgagctggctgctgagactgctgaacgacccagaggtgaagttcaactgg

SEQ ID NO: 456 - DNA, 48 bp, Artificial Sequence
  Description of Artificial Sequence: Synthetic primer
tctcagcagccagctcaggctgtcgccctcgtggctcacgtccaccac

SEQ ID NO: 457 - DNA, 51 bp, Artificial Sequence
  Description of Artificial Sequence: Synthetic primer
ctgagctggctgctgagactgctgaacccagaggtgaagttcaactggtac

SEQ ID NO: 458 - DNA, 48 bp, Artificial Sequence
  Description of Artificial Sequence: Synthetic primer
tctcagcagccagctcaggctgtcgccgtcctcgtggctcacgtccac

SEQ ID NO: 459 - DNA, 52 bp, Artificial Sequence
  Description of Artificial Sequence: Synthetic primer
ctgagctggctgctgagactgctgaacgaggtgaagttcaactggtacgtgg

SEQ ID NO: 460 - DNA, 48 bp, Artificial Sequence
  Description of Artificial Sequence: Synthetic primer
tctcagcagccagctcaggctgtcgcctgggtcctcgtggctcacgtc

SEQ ID NO: 461 - DNA, 47 bp, Artificial Sequence
  Description of Artificial Sequence: Synthetic primer
ctgagctggctgctgagactgctgaacggcgtggaggtgcacaacgc

SEQ ID NO: 462 - DNA, 52 bp, Artificial Sequence
  Description of Artificial Sequence: Synthetic primer
tctcagcagccagctcaggctgtcgccgtccacgtaccagttgaacttcacc

SEQ ID NO: 463 - DNA, 49 bp, Artificial Sequence
  Description of Artificial Sequence: Synthetic primer
ctgagctggctgctgagactgctgaacaacgccaagaccaagcccagag

SEQ ID NO: 464 - DNA, 46 bp, Artificial Sequence
  Description of Artificial Sequence: Synthetic primer
tctcagcagccagctcaggctgtcgccgtgcacctccacgccgtcc

SEQ ID NO: 465 - DNA, 48 bp, Artificial Sequence
  Description of Artificial Sequence: Synthetic primer
ctgagctggctgctgagactgctgaacgccaagaccaagcccagagag

SEQ ID NO: 466 - DNA, 48 bp, Artificial Sequence
  Description of Artificial Sequence: Synthetic primer
tctcagcagccagctcaggctgtcgccgttgtgcacctccacgccgtc

SEQ ID NO: 467 - DNA, 51 bp, Artificial Sequence
  Description of Artificial Sequence: Synthetic primer
ctgagctggctgctgagactgctgaacagagaggagcagtacaacagcacc

SEQ ID NO: 468 - DNA, 48 bp, Artificial Sequence
  Description of Artificial Sequence: Synthetic primer
tctcagcagccagctcaggctgtcgccgggcttggtcttggcgttgtg

SEQ ID NO: 469 - DNA, 48 bp, Artificial Sequence
  Description of Artificial Sequence: Synthetic primer
ctgagctggctgctgagactgctgaacgtgctgcaccaggactggctg

SEQ ID NO: 470 - DNA, 47 bp, Artificial Sequence
  Description of Artificial Sequence: Synthetic primer
tctcagcagccagctcaggctgtcgccggtcagcacggacaccaccc

SEQ ID NO: 471 - DNA, 48 bp, Artificial Sequence
  Description of Artificial Sequence: Synthetic primer
ctgagctggctgctgagactgctgaacctgcaccaggactggctgaac

SEQ ID NO: 472 - DNA, 48 bp, Artificial Sequence
  Description of Artificial Sequence: Synthetic primer
tctcagcagccagctcaggctgtcgcccacggtcagcacggacaccac

SEQ ID NO: 473 - DNA, 48 bp, Artificial Sequence
  Description of Artificial Sequence: Synthetic primer
ctgagctggctgctgagactgctgaaccaccaggactggctgaacggc

SEQ ID NO: 474 - DNA, 48 bp, Artificial Sequence
  Description of Artificial Sequence: Synthetic primer
tctcagcagccagctcaggctgtcgcccagcacggtcagcacggacac

SEQ ID NO: 475 - DNA, 48 bp, Artificial Sequence
  Description of Artificial Sequence: Synthetic primer
ctgagctggctgctgagactgctgaaccaggactggctgaacggcaag

SEQ ID NO: 476 - DNA, 47 bp, Artificial Sequence
  Description of Artificial Sequence: Synthetic primer
tctcagcagccagctcaggctgtcgccgtgcagcacggtcagcacgg

SEQ ID NO: 477 - DNA, 51 bp, Artificial Sequence
  Description of Artificial Sequence: Synthetic primer
ctgagctggctgctgagactgctgaacggcaaggaatacaagtgcaaggtc

SEQ ID NO: 478 - DNA, 48 bp, Artificial Sequence
  Description of Artificial Sequence: Synthetic primer
tctcagcagccagctcaggctgtcgccgttcagccagtcctggtgcag

SEQ ID NO: 479 - DNA, 54 bp, Artificial Sequence
  Description of Artificial Sequence: Synthetic primer
ctgagctggctgctgagactgctgaacaaggaatacaagtgcaaggtctccaac

SEQ ID NO: 480 - DNA, 48 bp, Artificial Sequence
  Description of Artificial Sequence: Synthetic primer
tctcagcagccagctcaggctgtcgccgccgttcagccagtcctggtg

SEQ ID NO: 481 - DNA, 54 bp, Artificial Sequence
  Description of Artificial Sequence: Synthetic primer
ctgagctggctgctgagactgctgaacgaatacaagtgcaaggtctccaacaag

SEQ ID NO: 482 - DNA, 48 bp, Artificial Sequence
  Description of Artificial Sequence: Synthetic primer
tctcagcagccagctcaggctgtcgcccttgccgttcagccagtcctg

SEQ ID NO: 483 - DNA, 45 bp, Artificial Sequence
  Description of Artificial Sequence: Synthetic primer
ctgagctggctgctgagactgctgaacgccctgccagcccccatc

SEQ ID NO: 484 - DNA, 54 bp, Artificial Sequence
  Description of Artificial Sequence: Synthetic primer
tctcagcagccagctcaggctgtcgcccttgttggagaccttgcacttgtattc

SEQ ID NO: 485 - DNA, 48 bp, Artificial Sequence
  Description of Artificial Sequence: Synthetic primer
ctgagctggctgctgagactgctgaacctgccagcccccatcgaaaag

SEQ ID NO: 486 - DNA, 49 bp, Artificial Sequence
  Description of Artificial Sequence: Synthetic primer
tctcagcagccagctcaggctgtcgccggccttgttggagaccttgcac

SEQ ID NO: 487 - DNA, 48 bp, Artificial Sequence
  Description of Artificial Sequence: Synthetic primer
ctgagctggctgctgagactgctgaacccagcccccatcgaaaagacc

SEQ ID NO: 488 - DNA, 49 bp, Artificial Sequence
  Description of Artificial Sequence: Synthetic primer
tctcagcagccagctcaggctgtcgcccagggccttgttggagaccttg

SEQ ID NO: 489 - DNA, 50 bp, Artificial Sequence
  Description of Artificial Sequence: Synthetic primer
ctgagctggctgctgagactgctgaacgcccccatcgaaaagaccatcag

SEQ ID NO: 490 - DNA, 48 bp, Artificial Sequence
  Description of Artificial Sequence: Synthetic primer
tctcagcagccagctcaggctgtcgcctggcagggccttgttggagac

SEQ ID NO: 491 - DNA, 51 bp, Artificial Sequence
  Description of Artificial Sequence: Synthetic primer
ctgagctggctgctgagactgctgaaccccatcgaaaagaccatcagcaag

SEQ ID NO: 492 - DNA, 47 bp, Artificial Sequence
  Description of Artificial Sequence: Synthetic primer
tctcagcagccagctcaggctgtcgccggctggcagggccttgttgg

SEQ ID NO: 493 - DNA, 46 bp, Artificial Sequence
  Description of Artificial Sequence: Synthetic primer
ctgagctggctgctgagactgctgaacaagggccagccacgggagc

SEQ ID NO: 494 - DNA, 52 bp, Artificial Sequence
  Description of Artificial Sequence: Synthetic primer
tctcagcagccagctcaggctgtcgccggccttgctgatggtcttttcgatg

SEQ ID NO: 495 - DNA, 45 bp, Artificial Sequence
  Description of Artificial Sequence: Synthetic primer
ctgagctggctgctgagactgctgaacggccagccacgggagccc

SEQ ID NO: 496 - DNA, 51 bp, Artificial Sequence
  Description of Artificial Sequence: Synthetic primer
tctcagcagccagctcaggctgtcgcccttggccttgctgatggtcttttc

SEQ ID NO: 497 - DNA, 45 bp, Artificial Sequence
  Description of Artificial Sequence: Synthetic primer
ctgagctggctgctgagactgctgaaccagccacgggagccccag

SEQ ID NO: 498 - DNA, 49 bp, Artificial Sequence
  Description of Artificial Sequence: Synthetic primer
tctcagcagccagctcaggctgtcgccgcccttggccttgctgatggtc

SEQ ID NO: 499 - DNA, 45 bp, Artificial Sequence
  Description of Artificial Sequence: Synthetic primer
ctgagctggctgctgagactgctgaacccacgggagccccaggtg

SEQ ID NO: 500 - DNA, 49 bp, Artificial Sequence
  Description of Artificial Sequence: Synthetic primer
tctcagcagccagctcaggctgtcgccctggcccttggccttgctgatg

SEQ ID NO: 501 - DNA, 47 bp, Artificial Sequence
  Description of Artificial Sequence: Synthetic primer
ctgagctggctgctgagactgctgaaccgggagccccaggtgtacac

SEQ ID NO: 502 - DNA, 47 bp, Artificial Sequence
  Description of Artificial Sequence: Synthetic primer
tctcagcagccagctcaggctgtcgcctggctggcccttggccttgc

SEQ ID NO: 503 - DNA, 48 bp, Artificial Sequence
  Description of Artificial Sequence: Synthetic primer
ctgagctggctgctgagactgctgaacgagccccaggtgtacaccctg

SEQ ID NO: 504 - DNA, 45 bp, Artificial Sequence
  Description of Artificial Sequence: Synthetic primer
tctcagcagccagctcaggctgtcgccccgtggctggcccttggc

SEQ ID NO: 505 - DNA, 51 bp, Artificial Sequence
  Description of Artificial Sequence: Synthetic primer
ctgagctggctgctgagactgctgaacgaggagatgaccaagaaccaggtg

SEQ ID NO: 506 - DNA, 44 bp, Artificial Sequence
  Description of Artificial Sequence: Synthetic primer
tctcagcagccagctcaggctgtcgccccgggaggggggcaggg

SEQ ID NO: 507 - DNA, 51 bp, Artificial Sequence
  Description of Artificial Sequence: Synthetic primer
ctgagctggctgctgagactgctgaacgagatgaccaagaaccaggtgtcc

SEQ ID NO: 508 - DNA, 45 bp, Artificial Sequence
  Description of Artificial Sequence: Synthetic primer
tctcagcagccagctcaggctgtcgccctcccgggaggggggcag

SEQ ID NO: 509 - DNA, 51 bp, Artificial Sequence
  Description of Artificial Sequence: Synthetic primer
ctgagctggctgctgagactgctgaacatgaccaagaaccaggtgtccctg

SEQ ID NO: 510 - DNA, 45 bp, Artificial Sequence
  Description of Artificial Sequence: Synthetic primer
tctcagcagccagctcaggctgtcgccctcctcccgggagggggg

SEQ ID NO: 511 - DNA, 50 bp, Artificial Sequence
  Description of Artificial Sequence: Synthetic primer
ctgagctggctgctgagactgctgaacaccaagaaccaggtgtccctgac

SEQ ID NO: 512 - DNA, 46 bp, Artificial Sequence
  Description of Artificial Sequence: Synthetic primer
tctcagcagccagctcaggctgtcgcccatctcctcccgggagggg

SEQ ID NO: 513 - DNA, 50 bp, Artificial Sequence
  Description of Artificial Sequence: Synthetic primer
ctgagctggctgctgagactgctgaacaagaaccaggtgtccctgacctg

SEQ ID NO: 514 - DNA, 47 bp, Artificial Sequence
  Description of Artificial Sequence: Synthetic primer
tctcagcagccagctcaggctgtcgccggtcatctcctcccgggagg

SEQ ID NO: 515 - DNA, 49 bp, Artificial Sequence
  Description of Artificial Sequence: Synthetic primer
ctgagctggctgctgagactgctgaacaaccaggtgtccctgacctgtc

SEQ ID NO: 516 - DNA, 49 bp, Artificial Sequence
  Description of Artificial Sequence: Synthetic primer
tctcagcagccagctcaggctgtcgcccttggtcatctcctcccgggag

SEQ ID NO: 517 - DNA, 48 bp, Artificial Sequence
  Description of Artificial Sequence: Synthetic primer
ctgagctggctgctgagactgctgaacggccagcccgagaacaactac

SEQ ID NO: 518 - DNA, 48 bp, Artificial Sequence
  Description of Artificial Sequence: Synthetic primer
tctcagcagccagctcaggctgtcgccgttgctctcccactccacggc

SEQ ID NO: 519 - DNA, 52 bp, Artificial Sequence
  Description of Artificial Sequence: Synthetic primer
ctgagctggctgctgagactgctgaacaacaactacaagaccacacctccag

SEQ ID NO: 520 - DNA, 46 bp, Artificial Sequence
  Description of Artificial Sequence: Synthetic primer
tctcagcagccagctcaggctgtcgccctcgggctggccgttgctc

SEQ ID NO: 521 - DNA, 52 bp, Artificial Sequence
  Description of Artificial Sequence: Synthetic primer
ctgagctggctgctgagactgctgaacaactacaagaccacacctccagtgc

SEQ ID NO: 522 - DNA, 47 bp, Artificial Sequence
  Description of Artificial Sequence: Synthetic primer
tctcagcagccagctcaggctgtcgccgttctcgggctggccgttgc

SEQ ID NO: 523 - DNA, 48 bp, Artificial Sequence
  Description of Artificial Sequence: Synthetic primer
ctgagctggctgctgagactgctgaaccctccagtgctggacagcgac

SEQ ID NO: 524 - DNA, 52 bp, Artificial Sequence
  Description of Artificial Sequence: Synthetic primer
tctcagcagccagctcaggctgtcgcctgtggtcttgtagttgttctcgggc

SEQ ID NO: 525 - DNA, 47 bp, Artificial Sequence
  Description of Artificial Sequence: Synthetic primer
ctgagctggctgctgagactgctgaacccagtgctggacagcgacgg

SEQ ID NO: 526 - DNA, 52 bp, Artificial Sequence
  Description of Artificial Sequence: Synthetic primer
tctcagcagccagctcaggctgtcgccaggtgtggtcttgtagttgttctcg

SEQ ID NO: 527 - DNA, 48 bp, Artificial Sequence
  Description of Artificial Sequence: Synthetic primer
ctgagctggctgctgagactgctgaacagcgacggcagcttcttcctg

SEQ ID NO: 528 - DNA, 49 bp, Artificial Sequence
  Description of Artificial Sequence: Synthetic primer
tctcagcagccagctcaggctgtcgccgtccagcactggaggtgtggtc

SEQ ID NO: 529 - DNA, 50 bp, Artificial Sequence
  Description of Artificial Sequence: Synthetic primer
ctgagctggctgctgagactgctgaacgacggcagcttcttcctgtacag

SEQ ID NO: 530 - DNA, 49 bp, Artificial Sequence
  Description of Artificial Sequence: Synthetic primer
tctcagcagccagctcaggctgtcgccgctgtccagcactggaggtgtg

SEQ ID NO: 531 - DNA, 51 bp, Artificial Sequence
  Description of Artificial Sequence: Synthetic primer
ctgagctggctgctgagactgctgaacggcagcttcttcctgtacagcaag

SEQ ID NO: 532 - DNA, 48 bp, Artificial Sequence
  Description of Artificial Sequence: Synthetic primer
tctcagcagccagctcaggctgtcgccgtcgctgtccagcactggagg

SEQ ID NO: 533 - DNA, 48 bp, Artificial Sequence
  Description of Artificial Sequence: Synthetic primer
ctgagctggctgctgagactgctgaacaggtggcagcagggcaacgtg

SEQ ID NO: 534 - DNA, 49 bp, Artificial Sequence
  Description of Artificial Sequence: Synthetic primer
tctcagcagccagctcaggctgtcgccggacttgtccacggtcagcttg

SEQ ID NO: 535 - DNA, 48 bp, Artificial Sequence
  Description of Artificial Sequence: Synthetic primer
ctgagctggctgctgagactgctgaactggcagcagggcaacgtgttc

SEQ ID NO: 536 - DNA, 48 bp, Artificial Sequence
  Description of Artificial Sequence: Synthetic primer
tctcagcagccagctcaggctgtcgcccctggacttgtccacggtcag

SEQ ID NO: 537 - DNA, 48 bp, Artificial Sequence
  Description of Artificial Sequence: Synthetic primer
ctgagctggctgctgagactgctgaaccagcagggcaacgtgttcagc

SEQ ID NO: 538 - DNA, 49 bp, Artificial Sequence
  Description of Artificial Sequence: Synthetic primer
tctcagcagccagctcaggctgtcgccccacctggacttgtccacggtc

SEQ ID NO: 539 - DNA, 48 bp, Artificial Sequence
  Description of Artificial Sequence: Synthetic primer
ctgagctggctgctgagactgctgaaccagggcaacgtgttcagctgc

SEQ ID NO: 540 - DNA, 48 bp, Artificial Sequence
  Description of Artificial Sequence: Synthetic primer
tctcagcagccagctcaggctgtcgccctgccacctggacttgtccac

SEQ ID NO: 541 - DNA, 48 bp, Artificial Sequence
  Description of Artificial Sequence: Synthetic primer
ctgagctggctgctgagactgctgaacggcaacgtgttcagctgcagc

SEQ ID NO: 542 - DNA, 48 bp, Artificial Sequence
  Description of Artificial Sequence: Synthetic primer
tctcagcagccagctcaggctgtcgccctgctgccacctggacttgtc

SEQ ID NO: 543 - DNA, 51 bp, Artificial Sequence
  Description of Artificial Sequence: Synthetic primer
ctgagctggctgctgagactgctgaacaacgtgttcagctgcagcgtgatg

SEQ ID NO: 544 - DNA, 46 bp, Artificial Sequence
  Description of Artificial Sequence: Synthetic primer
tctcagcagccagctcaggctgtcgccgccctgctgccacctggac

SEQ ID NO: 545 - DNA, 49 bp, Artificial Sequence
  Description of Artificial Sequence: Synthetic primer
ctgagctggctgctgagactgctgaacgtgttcagctgcagcgtgatgc

SEQ ID NO: 546 - DNA, 47 bp, Artificial Sequence
  Description of Artificial Sequence: Synthetic primer
tctcagcagccagctcaggctgtcgccgttgccctgctgccacctgg

SEQ ID NO: 547 - DNA, 51 bp, Artificial Sequence
  Description of Artificial Sequence: Synthetic primer
ctgagctggctgctgagactgctgaacaaccactacacccagaagagcctg

SEQ ID NO: 548 - DNA, 48 bp, Artificial Sequence
  Description of Artificial Sequence: Synthetic primer
tctcagcagccagctcaggctgtcgccgtgcagggcctcgtgcatcac

SEQ ID NO: 549 - DNA, 50 bp, Artificial Sequence
  Description of Artificial Sequence: Synthetic primer
ctgagctggctgctgagactgctgaaccactacacccagaagagcctgag

SEQ ID NO: 550 - DNA, 49 bp, Artificial Sequence
  Description of Artificial Sequence: Synthetic primer
tctcagcagccagctcaggctgtcgccgttgtgcagggcctcgtgcatc

SEQ ID NO: 551 - DNA, 50 bp, Artificial Sequence
  Description of Artificial Sequence: Synthetic primer
ctgagctggctgctgagactgctgaacctgtcccccggcaagtaatctag

SEQ ID NO: 552 - DNA, 49 bp, Artificial Sequence
  Description of Artificial Sequence: Synthetic primer
tctcagcagccagctcaggctgtcgccgctcaggctcttctgggtgtag

SEQ ID NO: 553 - DNA, 51 bp, Artificial Sequence
  Description of Artificial Sequence: Synthetic primer
ctgagctggctgctgagactgctgaactcccccggcaagtaatctagacac

SEQ ID NO: 554 - DNA, 49 bp, Artificial Sequence
  Description of Artificial Sequence: Synthetic primer
tctcagcagccagctcaggctgtcgcccaggctcaggctcttctgggtg

SEQ ID NO: 555 - DNA, 51 bp, Artificial Sequence
  Description of Artificial Sequence: Synthetic primer
ctgagctggctgctgagactgctgaaccccggcaagtaatctagacacctc

SEQ ID NO: 556 - DNA, 48 bp, Artificial Sequence
  Description of Artificial Sequence: Synthetic primer
tctcagcagccagctcaggctgtcgccggacaggctcaggctcttctg

SEQ ID NO: 557 - DNA, 52 bp, Artificial Sequence
  Description of Artificial Sequence: Synthetic primer
ctgagctggctgctgagactgctgaacggcaagtaatctagacacctcagac

SEQ ID NO: 558 - DNA, 46 bp, Artificial Sequence
  Description of Artificial Sequence: Synthetic primer
tctcagcagccagctcaggctgtcgccgggggacaggctcaggctc

SEQ ID NO: 559 - DNA, 56 bp, Artificial Sequence
  Description of Artificial Sequence: Synthetic primer
ctgagctggctgctgagactgctgaacaagtaatctagacacctcagacaatcaac

SEQ ID NO: 560 - DNA, 45 bp, Artificial Sequence
  Description of Artificial Sequence: Synthetic primer
tctcagcagccagctcaggctgtcgccgccgggggacaggctcag

SEQ ID NO: 561 - DNA, 46 bp, Artificial Sequence
  Description of Artificial Sequence: Synthetic primer
ctggagttcatcgccagcaagctggccagcaccaagggccccagcg

SEQ ID NO: 562 - DNA, 48 bp, Artificial Sequence
  Description of Artificial Sequence: Synthetic primer
cttgctggcgatgaactccaggctgtcagccgaggagacggtgaccag

SEQ ID NO: 563 - DNA, 48 bp, Artificial Sequence
  Description of Artificial Sequence: Synthetic primer
ctggagttcatcgccagcaagctggccaccaagggccccagcgtgttc

SEQ ID NO: 564 - DNA, 48 bp, Artificial Sequence
  Description of Artificial Sequence: Synthetic primer
cttgctggcgatgaactccaggctgtcgctagccgaggagacggtgac

SEQ ID NO: 565 - DNA, 47 bp, Artificial Sequence
  Description of Artificial Sequence: Synthetic primer
ctggagttcatcgccagcaagctggccaagggccccagcgtgttccc

SEQ ID NO: 566 - DNA, 47 bp, Artificial Sequence
  Description of Artificial Sequence: Synthetic primer
cttgctggcgatgaactccaggctgtcggtgctagccgaggagacgg

SEQ ID NO: 567 - DNA, 47 bp, Artificial Sequence
  Description of Artificial Sequence: Synthetic primer
ctggagttcatcgccagcaagctggccagcaagagcaccagcggcgg

SEQ ID NO: 568 - DNA, 46 bp, Artificial Sequence
  Description of Artificial Sequence: Synthetic primer
cttgctggcgatgaactccaggctgtcgctgggggccagggggaac

SEQ ID NO: 569 - DNA, 47 bp, Artificial Sequence
  Description of Artificial Sequence: Synthetic primer
ctggagttcatcgccagcaagctggccaagagcaccagcggcggcac

SEQ ID NO: 570 - DNA, 45 bp, Artificial Sequence
  Description of Artificial Sequence: Synthetic primer
cttgctggcgatgaactccaggctgtcgctgctgggggccagggg

SEQ ID NO: 571 - DNA, 46 bp, Artificial Sequence
  Description of Artificial Sequence: Synthetic primer
ctggagttcatcgccagcaagctggccagcaccagcggcggcacag

SEQ ID NO: 572 - DNA, 46 bp, Artificial Sequence
  Description of Artificial Sequence: Synthetic primer
cttgctggcgatgaactccaggctgtccttgctgctgggggccagg

SEQ ID NO: 573 - DNA, 45 bp, Artificial Sequence
  Description of Artificial Sequence: Synthetic primer
ctggagttcatcgccagcaagctggccaccagcggcggcacagcc

SEQ ID NO: 574 - DNA, 46 bp, Artificial Sequence
  Description of Artificial Sequence: Synthetic primer
cttgctggcgatgaactccaggctgtcgctcttgctgctgggggcc

SEQ ID NO: 575 - DNA, 45 bp, Artificial Sequence
  Description of Artificial Sequence: Synthetic primer
ctggagttcatcgccagcaagctggccagcggcggcacagccgcc

SEQ ID NO: 576 - DNA, 47 bp, Artificial Sequence
  Description of Artificial Sequence: Synthetic primer
cttgctggcgatgaactccaggctgtcggtgctcttgctgctggggg

SEQ ID NO: 577 - DNA, 45 bp, Artificial Sequence
  Description of Artificial Sequence: Synthetic primer
ctggagttcatcgccagcaagctggccggcggcacagccgccctg

SEQ ID NO: 578 - DNA, 48 bp, Artificial Sequence
  Description of Artificial Sequence: Synthetic primer
cttgctggcgatgaactccaggctgtcgctggtgctcttgctgctggg

SEQ ID NO: 579 - DNA, 45 bp, Artificial Sequence
  Description of Artificial Sequence: Synthetic primer
ctggagttcatcgccagcaagctggccggcacagccgccctgggc

SEQ ID NO: 580 - DNA, 47 bp, Artificial Sequence
  Description of Artificial Sequence: Synthetic primer
cttgctggcgatgaactccaggctgtcgccgctggtgctcttgctgc

SEQ ID NO: 581 - DNA, 45 bp, Artificial Sequence
  Description of Artificial Sequence: Synthetic primer
ctggagttcatcgccagcaagctggccacagccgccctgggctgc

SEQ ID NO: 582 - DNA, 46 bp, Artificial Sequence
  Description of Artificial Sequence: Synthetic primer
cttgctggcgatgaactccaggctgtcgccgccgctggtgctcttg

SEQ ID NO: 583 - DNA, 48 bp, Artificial Sequence
  Description of Artificial Sequence: Synthetic primer
ctggagttcatcgccagcaagctggcccccgtgaccgtgtcctggaac

SEQ ID NO: 584 - DNA, 49 bp, Artificial Sequence
  Description of Artificial Sequence: Synthetic primer
cttgctggcgatgaactccaggctgtcctcggggaagtagtccttcacc

SEQ ID NO: 585 - DNA, 49 bp, Artificial Sequence
  Description of Artificial Sequence: Synthetic primer
ctggagttcatcgccagcaagctggccgtgaccgtgtcctggaacagcg

SEQ ID NO: 586 - DNA, 49 bp, Artificial Sequence
  Description of Artificial Sequence: Synthetic primer
cttgctggcgatgaactccaggctgtcgggctcggggaagtagtccttc

SEQ ID NO: 587 - DNA, 46 bp, Artificial Sequence
  Description of Artificial Sequence: Synthetic primer
ctggagttcatcgccagcaagctggccagcggagccctgacctccg

SEQ ID NO: 588 - DNA, 48 bp, Artificial Sequence
  Description of Artificial Sequence: Synthetic primer
cttgctggcgatgaactccaggctgtcgttccaggacacggtcacggg

SEQ ID NO: 589 - DNA, 51 bp, Artificial Sequence
  Description of Artificial Sequence: Synthetic primer
ctggagttcatcgccagcaagctggccggagccctgacctccggcgtgcac

SEQ ID NO: 590 - DNA, 49 bp, Artificial Sequence
  Description of Artificial Sequence: Synthetic primer
cttgctggcgatgaactccaggctgtcgctgttccaggacacggtcacg

SEQ ID NO: 591 - DNA, 45 bp, Artificial Sequence
  Description of Artificial Sequence: Synthetic primer
ctggagttcatcgccagcaagctggccgccctgacctccggcgtg

SEQ ID NO: 592 - DNA, 47 bp, Artificial Sequence
  Description of Artificial Sequence: Synthetic primer
cttgctggcgatgaactccaggctgtctccgctgttccaggacacgg

SEQ ID NO: 593 - DNA, 47 bp, Artificial Sequence
  Description of Artificial Sequence: Synthetic primer
ctggagttcatcgccagcaagctggccctgacctccggcgtgcacac

SEQ ID NO: 594 - DNA, 48 bp, Artificial Sequence
  Description of Artificial Sequence: Synthetic primer
cttgctggcgatgaactccaggctgtcggctccgctgttccaggacac

SEQ ID NO: 595 - DNA, 48 bp, Artificial Sequence
  Description of Artificial Sequence: Synthetic primer
ctggagttcatcgccagcaagctggccacctccggcgtgcacaccttc

SEQ ID NO: 596 - DNA, 47 bp, Artificial Sequence
  Description of Artificial Sequence: Synthetic primer
cttgctggcgatgaactccaggctgtccagggctccgctgttccagg

SEQ ID NO: 597 - DNA, 47 bp, Artificial Sequence
  Description of Artificial Sequence: Synthetic primer
ctggagttcatcgccagcaagctggcctccggcgtgcacaccttccc

SEQ ID NO: 598 - DNA, 47 bp, Artificial Sequence
  Description of Artificial Sequence: Synthetic primer
cttgctggcgatgaactccaggctgtcggtcagggctccgctgttcc

SEQ ID NO: 599 - DNA, 46 bp, Artificial Sequence
  Description of Artificial Sequence: Synthetic primer
ctggagttcatcgccagcaagctggccggcgtgcacaccttccccg

SEQ ID NO: 600 - DNA, 46 bp, Artificial Sequence
  Description of Artificial Sequence: Synthetic primer
cttgctggcgatgaactccaggctgtcggaggtcagggctccgctg

SEQ ID NO: 601 - DNA, 46 bp, Artificial Sequence
  Description of Artificial Sequence: Synthetic primer
ctggagttcatcgccagcaagctggccgccgtgctgcagagcagcg

SEQ ID NO: 602 - DNA, 46 bp, Artificial Sequence
  Description of Artificial Sequence: Synthetic primer
cttgctggcgatgaactccaggctgtcggggaaggtgtgcacgccg

SEQ ID NO: 603 - DNA, 48 bp, Artificial Sequence
  Description of Artificial Sequence: Synthetic primer
ctggagttcatcgccagcaagctggccagcggcctgtacagcctgtcc

SEQ ID NO: 604 - DNA, 45 bp, Artificial Sequence
  Description of Artificial Sequence: Synthetic primer
cttgctggcgatgaactccaggctgtcgctctgcagcacggcggg

SEQ ID NO: 605 - DNA, 48 bp, Artificial Sequence
  Description of Artificial Sequence: Synthetic primer
ctggagttcatcgccagcaagctggccggcctgtacagcctgtccagc

SEQ ID NO: 606 - DNA, 46 bp, Artificial Sequence
  Description of Artificial Sequence: Synthetic primer
cttgctggcgatgaactccaggctgtcgctgctctgcagcacggcg

SEQ ID NO: 607 - DNA, 46 bp, Artificial Sequence
  Description of Artificial Sequence: Synthetic primer
ctggagttcatcgccagcaagctggccagcagcagcctgggcaccc

SEQ ID NO: 608 - DNA, 47 bp, Artificial Sequence
  Description of Artificial Sequence: Synthetic primer
cttgctggcgatgaactccaggctgtcgggcactgtcaccacgctgg

SEQ ID NO: 609 - DNA, 47 bp, Artificial Sequence
  Description of Artificial Sequence: Synthetic primer
ctggagttcatcgccagcaagctggccagcagcctgggcacccagac

SEQ ID NO: 610 - DNA, 47 bp, Artificial Sequence
  Description of Artificial Sequence: Synthetic primer
cttgctggcgatgaactccaggctgtcgctgggcactgtcaccacgc

SEQ ID NO: 611 - DNA, 48 bp, Artificial Sequence
  Description of Artificial Sequence: Synthetic primer
ctggagttcatcgccagcaagctggccagcctgggcacccagacctac

SEQ ID NO: 612 - DNA, 48 bp, Artificial Sequence
  Description of Artificial Sequence: Synthetic primer
cttgctggcgatgaactccaggctgtcgctgctgggcactgtcaccac

SEQ ID NO: 613 - DNA, 48 bp, Artificial Sequence
  Description of Artificial Sequence: Synthetic primer
ctggagttcatcgccagcaagctggccctgggcacccagacctacatc

SEQ ID NO: 614 - DNA, 48 bp, Artificial Sequence
  Description of Artificial Sequence: Synthetic primer
cttgctggcgatgaactccaggctgtcgctgctgctgggcactgtcac

SEQ ID NO: 615 - DNA, 48 bp, Artificial Sequence
  Description of Artificial Sequence: Synthetic primer
ctggagttcatcgccagcaagctggccggcacccagacctacatctgc

SEQ ID NO: 616 - DNA, 47 bp, Artificial Sequence
  Description of Artificial Sequence: Synthetic primer
cttgctggcgatgaactccaggctgtccaggctgctgctgggcactg

SEQ ID NO: 617 - DNA, 51 bp, Artificial Sequence
  Description of Artificial Sequence: Synthetic primer
ctggagttcatcgccagcaagctggccacccagacctacatctgcaacgtg

SEQ ID NO: 618 - DNA, 45 bp, Artificial Sequence
  Description of Artificial Sequence: Synthetic primer
cttgctggcgatgaactccaggctgtcgcccaggctgctgctggg

SEQ ID NO: 619 - DNA, 51 bp, Artificial Sequence
  Description of Artificial Sequence: Synthetic primer
ctggagttcatcgccagcaagctggcccagacctacatctgcaacgtgaac

SEQ ID NO: 620 - DNA, 46 bp, Artificial Sequence
  Description of Artificial Sequence: Synthetic primer
cttgctggcgatgaactccaggctgtcggtgcccaggctgctgctg

SEQ ID NO: 621 - DNA, 51 bp, Artificial Sequence
  Description of Artificial Sequence: Synthetic primer
ctggagttcatcgccagcaagctggccacctacatctgcaacgtgaaccac

SEQ ID NO: 622 - DNA, 46 bp, Artificial Sequence
  Description of Artificial Sequence: Synthetic primer
cttgctggcgatgaactccaggctgtcctgggtgcccaggctgctg

SEQ ID NO: 623 - DNA, 48 bp, Artificial Sequence
  Description of Artificial Sequence: Synthetic primer
ctggagttcatcgccagcaagctggcccccagcaacaccaaggtggac

SEQ ID NO: 624 - DNA, 53 bp, Artificial Sequence
  Description of Artificial Sequence: Synthetic primer
cttgctggcgatgaactccaggctgtccttgtggttcacgttgcagatgtagg

SEQ ID NO: 625 - DNA, 52 bp, Artificial Sequence
  Description of Artificial Sequence: Synthetic primer
ctggagttcatcgccagcaagctggccagcaacaccaaggtggacaagaaag

SEQ ID NO: 626 - DNA, 49 bp, Artificial Sequence
  Description of Artificial Sequence: Synthetic primer
cttgctggcgatgaactccaggctgtcgggcttgtggttcacgttgcag

SEQ ID NO: 627 - DNA, 52 bp, Artificial Sequence
  Description of Artificial Sequence: Synthetic primer
ctggagttcatcgccagcaagctggccaacaccaaggtggacaagaaagtgg

SEQ ID NO: 628 - DNA, 49 bp, Artificial Sequence
  Description of Artificial Sequence: Synthetic primer
cttgctggcgatgaactccaggctgtcgctgggcttgtggttcacgttg

SEQ ID NO: 629 - DNA, 45 bp, Artificial Sequence
  Description of Artificial Sequence: Synthetic primer
ctggagttcatcgccagcaagctggccgccccagagctgctgggc

SEQ ID NO: 630 - DNA, 46 bp, Artificial Sequence
  Description of Artificial Sequence: Synthetic primer
cttgctggcgatgaactccaggctgtctgggcagggggggcaggtg

SEQ ID NO: 631 - DNA, 46 bp, Artificial Sequence
  Description of Artificial Sequence: Synthetic primer
ctggagttcatcgccagcaagctggccccagagctgctgggcggac

SEQ ID NO: 632 - DNA, 44 bp, Artificial Sequence
  Description of Artificial Sequence: Synthetic primer
cttgctggcgatgaactccaggctgtcggctgggcagggggggc

SEQ ID NO: 633 - DNA, 45 bp, Artificial Sequence
  Description of Artificial Sequence: Synthetic primer
ctggagttcatcgccagcaagctggccgagctgctgggcggaccc

SEQ ID NO: 634 - DNA, 45 bp, Artificial Sequence
  Description of Artificial Sequence: Synthetic primer
cttgctggcgatgaactccaggctgtctggggctgggcagggggg

SEQ ID NO: 635 - DNA, 45 bp, Artificial Sequence
  Description of Artificial Sequence: Synthetic primer
ctggagttcatcgccagcaagctggccctgctgggcggaccctcc

SEQ ID NO: 636 - DNA, 45 bp, Artificial Sequence
  Description of Artificial Sequence: Synthetic primer
cttgctggcgatgaactccaggctgtcctctggggctgggcaggg

SEQ ID NO: 637 - DNA, 45 bp, Artificial Sequence
  Description of Artificial Sequence: Synthetic primer
ctggagttcatcgccagcaagctggccctgggcggaccctccgtg

SEQ ID NO: 638 - DNA, 46 bp, Artificial Sequence
  Description of Artificial Sequence: Synthetic primer
cttgctggcgatgaactccaggctgtccagctctggggctgggcag

SEQ ID NO: 639 - DNA, 46 bp, Artificial Sequence
  Description of Artificial Sequence: Synthetic primer
ctggagttcatcgccagcaagctggccggcggaccctccgtgttcc

SEQ ID NO: 640 - DNA, 46 bp, Artificial Sequence
  Description of Artificial Sequence: Synthetic primer
cttgctggcgatgaactccaggctgtccagcagctctggggctggg

SEQ ID NO: 641 - DNA, 49 bp, Artificial Sequence
  Description of Artificial Sequence: Synthetic primer
ctggagttcatcgccagcaagctggccggaccctccgtgttcctgttcc

SEQ ID NO: 642 - DNA, 45 bp, Artificial Sequence
  Description of Artificial Sequence: Synthetic primer
cttgctggcgatgaactccaggctgtcgcccagcagctctggggc

SEQ ID NO: 643 - DNA, 48 bp, Artificial Sequence
  Description of Artificial Sequence: Synthetic primer
ctggagttcatcgccagcaagctggcccccaagcccaaggacaccctg

SEQ ID NO: 644 - DNA, 48 bp, Artificial Sequence
  Description of Artificial Sequence: Synthetic primer
cttgctggcgatgaactccaggctgtcggggaacaggaacacggaggg

SEQ ID NO: 645 - DNA, 51 bp, Artificial Sequence
  Description of Artificial Sequence: Synthetic primer
ctggagttcatcgccagcaagctggccaagcccaaggacaccctgatgatc

SEQ ID NO: 646 - DNA, 47 bp, Artificial Sequence
  Description of Artificial Sequence: Synthetic primer
cttgctggcgatgaactccaggctgtcgggggggaacaggaacacgg

SEQ ID NO: 647 - DNA, 47 bp, Artificial Sequence
  Description of Artificial Sequence: Synthetic primer
ctggagttcatcgccagcaagctggccagcaggacccccgaggtgac

SEQ ID NO: 648 - DNA, 49 bp, Artificial Sequence
  Description of Artificial Sequence: Synthetic primer
cttgctggcgatgaactccaggctgtcgatcatcagggtgtccttgggc

SEQ ID NO: 649 - DNA, 47 bp, Artificial Sequence
  Description of Artificial Sequence: Synthetic primer
ctggagttcatcgccagcaagctggccaggacccccgaggtgacctg

SEQ ID NO: 650 - DNA, 50 bp, Artificial Sequence
  Description of Artificial Sequence: Synthetic primer
cttgctggcgatgaactccaggctgtcgctgatcatcagggtgtccttgg

SEQ ID NO: 651 - DNA, 46 bp, Artificial Sequence
  Description of Artificial Sequence: Synthetic primer
ctggagttcatcgccagcaagctggccacccccgaggtgacctgcg

SEQ ID NO: 652 - DNA, 49 bp, Artificial Sequence
  Description of Artificial Sequence: Synthetic primer
cttgctggcgatgaactccaggctgtccctgctgatcatcagggtgtcc

SEQ ID NO: 653 - DNA, 46 bp, Artificial Sequence
  Description of Artificial Sequence: Synthetic primer
ctggagttcatcgccagcaagctggcccccgaggtgacctgcgtgg

SEQ ID NO: 654 - DNA, 49 bp, Artificial Sequence
  Description of Artificial Sequence: Synthetic primer
cttgctggcgatgaactccaggctgtcggtcctgctgatcatcagggtg

SEQ ID NO: 655 - DNA, 48 bp, Artificial Sequence
  Description of Artificial Sequence: Synthetic primer
ctggagttcatcgccagcaagctggccgaggtgacctgcgtggtggtg

SEQ ID NO: 656 - DNA, 48 bp, Artificial Sequence
  Description of Artificial Sequence: Synthetic primer
cttgctggcgatgaactccaggctgtcgggggtcctgctgatcatcag

SEQ ID NO: 657 - DNA, 51 bp, Artificial Sequence
  Description of Artificial Sequence: Synthetic primer
ctggagttcatcgccagcaagctggcccacgaggacccagaggtgaagttc

SEQ ID NO: 658 - DNA, 47 bp, Artificial Sequence
  Description of Artificial Sequence: Synthetic primer
cttgctggcgatgaactccaggctgtcgctcacgtccaccaccacgc

SEQ ID NO: 659 - DNA, 51 bp, Artificial Sequence
  Description of Artificial Sequence: Synthetic primer
ctggagttcatcgccagcaagctggccgaggacccagaggtgaagttcaac

SEQ ID NO: 660 - DNA, 48 bp, Artificial Sequence
  Description of Artificial Sequence: Synthetic primer
cttgctggcgatgaactccaggctgtcgtggctcacgtccaccaccac

SEQ ID NO: 661 - DNA, 51 bp, Artificial Sequence
  Description of Artificial Sequence: Synthetic primer
ctggagttcatcgccagcaagctggccgacccagaggtgaagttcaactgg

SEQ ID NO: 662 - DNA, 48 bp, Artificial Sequence
  Description of Artificial Sequence: Synthetic primer
cttgctggcgatgaactccaggctgtcctcgtggctcacgtccaccac

SEQ ID NO: 663 - DNA, 51 bp, Artificial Sequence
  Description of Artificial Sequence: Synthetic primer
ctggagttcatcgccagcaagctggccccagaggtgaagttcaactggtac

SEQ ID NO: 664 - DNA, 48 bp, Artificial Sequence
  Description of Artificial Sequence: Synthetic primer
cttgctggcgatgaactccaggctgtcgtcctcgtggctcacgtccac

SEQ ID NO: 665 - DNA, 52 bp, Artificial Sequence
  Description of Artificial Sequence: Synthetic primer
ctggagttcatcgccagcaagctggccgaggtgaagttcaactggtacgtgg

SEQ ID NO: 666 - DNA, 48 bp, Artificial Sequence
  Description of Artificial Sequence: Synthetic primer
cttgctggcgatgaactccaggctgtctgggtcctcgtggctcacgtc

SEQ ID NO: 667 - DNA, 47 bp, Artificial Sequence
  Description of Artificial Sequence: Synthetic primer
ctggagttcatcgccagcaagctggccggcgtggaggtgcacaacgc

SEQ ID NO: 668 - DNA, 52 bp, Artificial Sequence
  Description of Artificial Sequence: Synthetic primer
cttgctggcgatgaactccaggctgtcgtccacgtaccagttgaacttcacc

SEQ ID NO: 669 - DNA, 49 bp, Artificial Sequence
  Description of Artificial Sequence: Synthetic primer
ctggagttcatcgccagcaagctggccaacgccaagaccaagcccagag

SEQ ID NO: 670 - DNA, 46 bp, Artificial Sequence
  Description of Artificial Sequence: Synthetic primer
cttgctggcgatgaactccaggctgtcgtgcacctccacgccgtcc

SEQ ID NO: 671 - DNA, 48 bp, Artificial Sequence
  Description of Artificial Sequence: Synthetic primer
ctggagttcatcgccagcaagctggccgccaagaccaagcccagagag

SEQ ID NO: 672 - DNA, 48 bp, Artificial Sequence
  Description of Artificial Sequence: Synthetic primer
cttgctggcgatgaactccaggctgtcgttgtgcacctccacgccgtc

SEQ ID NO: 673 - DNA, 51 bp, Artificial Sequence
  Description of Artificial Sequence: Synthetic primer
ctggagttcatcgccagcaagctggccagagaggagcagtacaacagcacc

SEQ ID NO: 674 - DNA, 48 bp, Artificial Sequence
  Description of Artificial Sequence: Synthetic primer
cttgctggcgatgaactccaggctgtcgggcttggtcttggcgttgtg

SEQ ID NO: 675 - DNA, 48 bp, Artificial Sequence
  Description of Artificial Sequence: Synthetic primer
ctggagttcatcgccagcaagctggccgtgctgcaccaggactggctg

SEQ ID NO: 676 - DNA, 47 bp, Artificial Sequence
  Description of Artificial Sequence: Synthetic primer
cttgctggcgatgaactccaggctgtcggtcagcacggacaccaccc

SEQ ID NO: 677 - DNA, 48 bp, Artificial Sequence
  Description of Artificial Sequence: Synthetic primer
ctggagttcatcgccagcaagctggccctgcaccaggactggctgaac

SEQ ID NO: 678 - DNA, 48 bp, Artificial Sequence
  Description of Artificial Sequence: Synthetic primer
cttgctggcgatgaactccaggctgtccacggtcagcacggacaccac

SEQ ID NO: 679 - DNA, 48 bp, Artificial Sequence
  Description of Artificial Sequence: Synthetic primer
ctggagttcatcgccagcaagctggcccaccaggactggctgaacggc

SEQ ID NO: 680 - DNA, 48 bp, Artificial Sequence
  Description of Artificial Sequence: Synthetic primer
cttgctggcgatgaactccaggctgtccagcacggtcagcacggacac

SEQ ID NO: 681 - DNA, 48 bp, Artificial Sequence
  Description of Artificial Sequence: Synthetic primer
ctggagttcatcgccagcaagctggcccaggactggctgaacggcaag

SEQ ID NO: 682 - DNA, 47 bp, Artificial Sequence
  Description of Artificial Sequence: Synthetic primer
cttgctggcgatgaactccaggctgtcgtgcagcacggtcagcacgg

SEQ ID NO: 683 - DNA, 51 bp, Artificial Sequence
  Description of Artificial Sequence: Synthetic primer
ctggagttcatcgccagcaagctggccggcaaggaatacaagtgcaaggtc

SEQ ID NO: 684 - DNA, 48 bp, Artificial Sequence
  Description of Artificial Sequence: Synthetic primer
cttgctggcgatgaactccaggctgtcgttcagccagtcctggtgcag

SEQ ID NO: 685 - DNA, 54 bp, Artificial Sequence
  Description of Artificial Sequence: Synthetic primer
ctggagttcatcgccagcaagctggccaaggaatacaagtgcaaggtctccaac

SEQ ID NO: 686 - DNA, 48 bp, Artificial Sequence
  Description of Artificial Sequence: Synthetic primer
cttgctggcgatgaactccaggctgtcgccgttcagccagtcctggtg

SEQ ID NO: 687 - DNA, 54 bp, Artificial Sequence
  Description of Artificial Sequence: Synthetic primer
ctggagttcatcgccagcaagctggccgaatacaagtgcaaggtctccaacaag

SEQ ID NO: 688 - DNA, 48 bp, Artificial Sequence
  Description of Artificial Sequence: Synthetic primer
cttgctggcgatgaactccaggctgtccttgccgttcagccagtcctg

SEQ ID NO: 689 - DNA, 45 bp, Artificial Sequence
  Description of Artificial Sequence: Synthetic primer
ctggagttcatcgccagcaagctggccgccctgccagcccccatc

SEQ ID NO: 690 - DNA, 54 bp, Artificial Sequence
  Description of Artificial Sequence: Synthetic primer
cttgctggcgatgaactccaggctgtccttgttggagaccttgcacttgtattc

SEQ ID NO: 691 - DNA, 48 bp, Artificial Sequence
  Description of Artificial Sequence: Synthetic primer
ctggagttcatcgccagcaagctggccctgccagcccccatcgaaaag

SEQ ID NO: 692 - DNA, 49 bp, Artificial Sequence
  Description of Artificial Sequence: Synthetic primer
cttgctggcgatgaactccaggctgtcggccttgttggagaccttgcac

SEQ ID NO: 693 - DNA, 48 bp, Artificial Sequence
  Description of Artificial Sequence: Synthetic primer
ctggagttcatcgccagcaagctggccccagcccccatcgaaaagacc

SEQ ID NO: 694 - DNA, 49 bp, Artificial Sequence
  Description of Artificial Sequence: Synthetic primer
cttgctggcgatgaactccaggctgtccagggccttgttggagaccttg

SEQ ID NO: 695 - DNA, 50 bp, Artificial Sequence
  Description of Artificial Sequence: Synthetic primer
ctggagttcatcgccagcaagctggccgcccccatcgaaaagaccatcag

SEQ ID NO: 696 - DNA, 48 bp, Artificial Sequence
  Description of Artificial Sequence: Synthetic primer
cttgctggcgatgaactccaggctgtctggcagggccttgttggagac

SEQ ID NO: 697 - DNA, 51 bp, Artificial Sequence
  Description of Artificial Sequence: Synthetic primer
ctggagttcatcgccagcaagctggcccccatcgaaaagaccatcagcaag

SEQ ID NO: 698 - DNA, 47 bp, Artificial Sequence
  Description of Artificial Sequence: Synthetic primer
cttgctggcgatgaactccaggctgtcggctggcagggccttgttgg

SEQ ID NO: 699 - DNA, 46 bp, Artificial Sequence
  Description of Artificial Sequence: Synthetic primer
ctggagttcatcgccagcaagctggccaagggccagccacgggagc

SEQ ID NO: 700 - DNA, 52 bp, Artificial Sequence
  Description of Artificial Sequence: Synthetic primer
cttgctggcgatgaactccaggctgtcggccttgctgatggtcttttcgatg

SEQ ID NO: 701 - DNA, 45 bp, Artificial Sequence
  Description of Artificial Sequence: Synthetic primer
ctggagttcatcgccagcaagctggccggccagccacgggagccc

SEQ ID NO: 702 - DNA, 51 bp, Artificial Sequence
  Description of Artificial Sequence: Synthetic primer
cttgctggcgatgaactccaggctgtccttggccttgctgatggtcttttc

SEQ ID NO: 703 - DNA, 45 bp, Artificial Sequence
  Description of Artificial Sequence: Synthetic primer
ctggagttcatcgccagcaagctggcccagccacgggagccccag

SEQ ID NO: 704 - DNA, 49 bp, Artificial Sequence
  Description of Artificial Sequence: Synthetic primer
cttgctggcgatgaactccaggctgtcgcccttggccttgctgatggtc

SEQ ID NO: 705 - DNA, 45 bp, Artificial Sequence
  Description of Artificial Sequence: Synthetic primer
ctggagttcatcgccagcaagctggccccacgggagccccaggtg

SEQ ID NO: 706 - DNA, 49 bp, Artificial Sequence
  Description of Artificial Sequence: Synthetic primer
cttgctggcgatgaactccaggctgtcctggcccttggccttgctgatg

SEQ ID NO: 707 - DNA, 47 bp, Artificial Sequence
  Description of Artificial Sequence: Synthetic primer
ctggagttcatcgccagcaagctggcccgggagccccaggtgtacac

SEQ ID NO: 708 - DNA, 47 bp, Artificial Sequence
  Description of Artificial Sequence: Synthetic primer
cttgctggcgatgaactccaggctgtctggctggcccttggccttgc

SEQ ID NO: 709 - DNA, 48 bp, Artificial Sequence
  Description of Artificial Sequence: Synthetic primer
ctggagttcatcgccagcaagctggccgagccccaggtgtacaccctg

SEQ ID NO: 710 - DNA, 45 bp, Artificial Sequence
  Description of Artificial Sequence: Synthetic primer
cttgctggcgatgaactccaggctgtcccgtggctggcccttggc

SEQ ID NO: 711 - DNA, 51 bp, Artificial Sequence
  Description of Artificial Sequence: Synthetic primer
ctggagttcatcgccagcaagctggccgaggagatgaccaagaaccaggtg

SEQ ID NO: 712 - DNA, 44 bp, Artificial Sequence
  Description of Artificial Sequence: Synthetic primer
cttgctggcgatgaactccaggctgtcccgggaggggggcaggg

SEQ ID NO: 713 - DNA, 51 bp, Artificial Sequence
  Description of Artificial Sequence: Synthetic primer
ctggagttcatcgccagcaagctggccgagatgaccaagaaccaggtgtcc

SEQ ID NO: 714 - DNA, 45 bp, Artificial Sequence
  Description of Artificial Sequence: Synthetic primer
cttgctggcgatgaactccaggctgtcctcccgggaggggggcag

SEQ ID NO: 715 - DNA, 51 bp, Artificial Sequence
  Description of Artificial Sequence: Synthetic primer
ctggagttcatcgccagcaagctggccatgaccaagaaccaggtgtccctg

SEQ ID NO: 716 - DNA, 45 bp, Artificial Sequence
  Description of Artificial Sequence: Synthetic primer
cttgctggcgatgaactccaggctgtcctcctcccgggagggggg

SEQ ID NO: 717 - DNA, 50 bp, Artificial Sequence
  Description of Artificial Sequence: Synthetic primer
ctggagttcatcgccagcaagctggccaccaagaaccaggtgtccctgac

SEQ ID NO: 718 - DNA, 46 bp, Artificial Sequence
  Description of Artificial Sequence: Synthetic primer
cttgctggcgatgaactccaggctgtccatctcctcccgggagggg

SEQ ID NO: 719 - DNA, 50 bp, Artificial Sequence
  Description of Artificial Sequence: Synthetic primer
ctggagttcatcgccagcaagctggccaagaaccaggtgtccctgacctg

SEQ ID NO: 720 - DNA, 47 bp, Artificial Sequence
  Description of Artificial Sequence: Synthetic primer
cttgctggcgatgaactccaggctgtcggtcatctcctcccgggagg

SEQ ID NO: 721 - DNA, 49 bp, Artificial Sequence
  Description of Artificial Sequence: Synthetic primer
ctggagttcatcgccagcaagctggccaaccaggtgtccctgacctgtc

SEQ ID NO: 722 - DNA, 49 bp, Artificial Sequence
  Description of Artificial Sequence: Synthetic primer
cttgctggcgatgaactccaggctgtccttggtcatctcctcccgggag

SEQ ID NO: 723 - DNA, 48 bp, Artificial Sequence
  Description of Artificial Sequence: Synthetic primer
ctggagttcatcgccagcaagctggccggccagcccgagaacaactac

SEQ ID NO: 724 - DNA, 48 bp, Artificial Sequence
  Description of Artificial Sequence: Synthetic primer
cttgctggcgatgaactccaggctgtcgttgctctcccactccacggc

SEQ ID NO: 725 - DNA, 52 bp, Artificial Sequence
  Description of Artificial Sequence: Synthetic primer
ctggagttcatcgccagcaagctggccaacaactacaagaccacacctccag

SEQ ID NO: 726 - DNA, 46 bp, Artificial Sequence
  Description of Artificial Sequence: Synthetic primer
cttgctggcgatgaactccaggctgtcctcgggctggccgttgctc

SEQ ID NO: 727 - DNA, 52 bp, Artificial Sequence
  Description of Artificial Sequence: Synthetic primer
ctggagttcatcgccagcaagctggccaactacaagaccacacctccagtgc

SEQ ID NO: 728 - DNA, 47 bp, Artificial Sequence
  Description of Artificial Sequence: Synthetic primer
cttgctggcgatgaactccaggctgtcgttctcgggctggccgttgc

SEQ ID NO: 729 - DNA, 48 bp, Artificial Sequence
  Description of Artificial Sequence: Synthetic primer
ctggagttcatcgccagcaagctggcccctccagtgctggacagcgac

SEQ ID NO: 730 - DNA, 52 bp, Artificial Sequence
  Description of Artificial Sequence: Synthetic primer
cttgctggcgatgaactccaggctgtctgtggtcttgtagttgttctcgggc

SEQ ID NO: 731 - DNA, 47 bp, Artificial Sequence
  Description of Artificial Sequence: Synthetic primer
ctggagttcatcgccagcaagctggccccagtgctggacagcgacgg

SEQ ID NO: 732 - DNA, 52 bp, Artificial Sequence
  Description of Artificial Sequence: Synthetic primer
cttgctggcgatgaactccaggctgtcaggtgtggtcttgtagttgttctcg

SEQ ID NO: 733 - DNA, 48 bp, Artificial Sequence
  Description of Artificial Sequence: Synthetic primer
ctggagttcatcgccagcaagctggccagcgacggcagcttcttcctg

SEQ ID NO: 734 - DNA, 49 bp, Artificial Sequence
  Description of Artificial Sequence: Synthetic primer
cttgctggcgatgaactccaggctgtcgtccagcactggaggtgtggtc

SEQ ID NO: 735 - DNA, 50 bp, Artificial Sequence
  Description of Artificial Sequence: Synthetic primer
ctggagttcatcgccagcaagctggccgacggcagcttcttcctgtacag

SEQ ID NO: 736 - DNA, 49 bp, Artificial Sequence
  Description of Artificial Sequence: Synthetic primer
cttgctggcgatgaactccaggctgtcgctgtccagcactggaggtgtg

SEQ ID NO: 737 - DNA, 51 bp, Artificial Sequence
  Description of Artificial Sequence: Synthetic primer
ctggagttcatcgccagcaagctggccggcagcttcttcctgtacagcaag

SEQ ID NO: 738 - DNA, 48 bp, Artificial Sequence
  Description of Artificial Sequence: Synthetic primer
cttgctggcgatgaactccaggctgtcgtcgctgtccagcactggagg

SEQ ID NO: 739 - DNA, 48 bp, Artificial Sequence
  Description of Artificial Sequence: Synthetic primer
ctggagttcatcgccagcaagctggccaggtggcagcagggcaacgtg

SEQ ID NO: 740 - DNA, 49 bp, Artificial Sequence
  Description of Artificial Sequence: Synthetic primer
cttgctggcgatgaactccaggctgtcggacttgtccacggtcagcttg

SEQ ID NO: 741 - DNA, 48 bp, Artificial Sequence
  Description of Artificial Sequence: Synthetic primer
ctggagttcatcgccagcaagctggcctggcagcagggcaacgtgttc

SEQ ID NO: 742 - DNA, 48 bp, Artificial Sequence
  Description of Artificial Sequence: Synthetic primer
cttgctggcgatgaactccaggctgtccctggacttgtccacggtcag

SEQ ID NO: 743 - DNA, 48 bp, Artificial Sequence
  Description of Artificial Sequence: Synthetic primer
ctggagttcatcgccagcaagctggcccagcagggcaacgtgttcagc

SEQ ID NO: 744 - DNA, 49 bp, Artificial Sequence
  Description of Artificial Sequence: Synthetic primer
cttgctggcgatgaactccaggctgtcccacctggacttgtccacggtc

SEQ ID NO: 745 - DNA, 48 bp, Artificial Sequence
  Description of Artificial Sequence: Synthetic primer
ctggagttcatcgccagcaagctggcccagggcaacgtgttcagctgc

SEQ ID NO: 746 - DNA, 48 bp, Artificial Sequence
  Description of Artificial Sequence: Synthetic primer
cttgctggcgatgaactccaggctgtcctgccacctggacttgtccac

SEQ ID NO: 747 - DNA, 48 bp, Artificial Sequence
  Description of Artificial Sequence: Synthetic primer
ctggagttcatcgccagcaagctggccggcaacgtgttcagctgcagc

SEQ ID NO: 748 - DNA, 48 bp, Artificial Sequence
  Description of Artificial Sequence: Synthetic primer
cttgctggcgatgaactccaggctgtcctgctgccacctggacttgtc

SEQ ID NO: 749 - DNA, 51 bp, Artificial Sequence
  Description of Artificial Sequence: Synthetic primer
ctggagttcatcgccagcaagctggccaacgtgttcagctgcagcgtgatg

SEQ ID NO: 750 - DNA, 46 bp, Artificial Sequence
  Description of Artificial Sequence: Synthetic primer
cttgctggcgatgaactccaggctgtcgccctgctgccacctggac

SEQ ID NO: 751 - DNA, 49 bp, Artificial Sequence
  Description of Artificial Sequence: Synthetic primer
ctggagttcatcgccagcaagctggccgtgttcagctgcagcgtgatgc

SEQ ID NO: 752 - DNA, 47 bp, Artificial Sequence
  Description of Artificial Sequence: Synthetic primer
cttgctggcgatgaactccaggctgtcgttgccctgctgccacctgg

SEQ ID NO: 753 - DNA, 51 bp, Artificial Sequence
  Description of Artificial Sequence: Synthetic primer
ctggagttcatcgccagcaagctggccaaccactacacccagaagagcctg

SEQ ID NO: 754 - DNA, 48 bp, Artificial Sequence
  Description of Artificial Sequence: Synthetic primer
cttgctggcgatgaactccaggctgtcgtgcagggcctcgtgcatcac

SEQ ID NO: 755 - DNA, 50 bp, Artificial Sequence
  Description of Artificial Sequence: Synthetic primer
ctggagttcatcgccagcaagctggcccactacacccagaagagcctgag

SEQ ID NO: 756 - DNA, 49 bp, Artificial Sequence
  Description of Artificial Sequence: Synthetic primer
cttgctggcgatgaactccaggctgtcgttgtgcagggcctcgtgcatc

SEQ ID NO: 757 - DNA, 50 bp, Artificial Sequence
  Description of Artificial Sequence: Synthetic primer
ctggagttcatcgccagcaagctggccctgtcccccggcaagtaatctag

SEQ ID NO: 758 - DNA, 49 bp, Artificial Sequence
  Description of Artificial Sequence: Synthetic primer
cttgctggcgatgaactccaggctgtcgctcaggctcttctgggtgtag

SEQ ID NO: 759 - DNA, 51 bp, Artificial Sequence
  Description of Artificial Sequence: Synthetic primer
ctggagttcatcgccagcaagctggcctcccccggcaagtaatctagacac

SEQ ID NO: 760 - DNA, 49 bp, Artificial Sequence
  Description of Artificial Sequence: Synthetic primer
cttgctggcgatgaactccaggctgtccaggctcaggctcttctgggtg

SEQ ID NO: 761 - DNA, 51 bp, Artificial Sequence
  Description of Artificial Sequence: Synthetic primer
ctggagttcatcgccagcaagctggcccccggcaagtaatctagacacctc

SEQ ID NO: 762 - DNA, 48 bp, Artificial Sequence
  Description of Artificial Sequence: Synthetic primer
cttgctggcgatgaactccaggctgtcggacaggctcaggctcttctg

SEQ ID NO: 763 - DNA, 52 bp, Artificial Sequence
  Description of Artificial Sequence: Synthetic primer
ctggagttcatcgccagcaagctggccggcaagtaatctagacacctcagac

SEQ ID NO: 764 - DNA, 46 bp, Artificial Sequence
  Description of Artificial Sequence: Synthetic primer
cttgctggcgatgaactccaggctgtcgggggacaggctcaggctc

SEQ ID NO: 765 - DNA, 56 bp, Artificial Sequence
  Description of Artificial Sequence: Synthetic primer
ctggagttcatcgccagcaagctggccaagtaatctagacacctcagacaatcaac

SEQ ID NO: 766 - DNA, 45 bp, Artificial Sequence
  Description of Artificial Sequence: Synthetic primer
cttgctggcgatgaactccaggctgtcgccgggggacaggctcag

SEQ ID NO: 767 - DNA, 45 bp, Artificial Sequence
  Description of Artificial Sequence: Synthetic primer
ctgagctggctgctgagactgctgaacgtggccgctcccagcgtg

SEQ ID NO: 768 - DNA, 51 bp, Artificial Sequence
  Description of Artificial Sequence: Synthetic primer
tctcagcagccagctcaggctgtcgcccgttcgtttgatctccaccttggt

SEQ ID NO: 769 - DNA, 48 bp, Artificial Sequence
  Description of Artificial Sequence: Synthetic primer
ctgagctggctgctgagactgctgaacgccgctcccagcgtgttcatc

SEQ ID NO: 770 - DNA, 52 bp, Artificial Sequence
  Description of Artificial Sequence: Synthetic primer
tctcagcagccagctcaggctgtcgcccaccgttcgtttgatctccaccttg

SEQ ID NO: 771 - DNA, 49 bp, Artificial Sequence
  Description of Artificial Sequence: Synthetic primer
ctgagctggctgctgagactgctgaacgctcccagcgtgttcatcttcc

SEQ ID NO: 772 - DNA, 49 bp, Artificial Sequence
  Description of Artificial Sequence: Synthetic primer
tctcagcagccagctcaggctgtcgccggccaccgttcgtttgatctcc

SEQ ID NO: 773 - DNA, 48 bp, Artificial Sequence
  Description of Artificial Sequence: Synthetic primer
ctgagctggctgctgagactgctgaaccccagcgacgagcagctgaag

SEQ ID NO: 774 - DNA, 48 bp, Artificial Sequence
  Description of Artificial Sequence: Synthetic primer
tctcagcagccagctcaggctgtcgccggggaagatgaacacgctggg

SEQ ID NO: 775 - DNA, 48 bp, Artificial Sequence
  Description of Artificial Sequence: Synthetic primer
ctgagctggctgctgagactgctgaacagcgacgagcagctgaagagc

SEQ ID NO: 776 - DNA, 49 bp, Artificial Sequence
  Description of Artificial Sequence: Synthetic primer
tctcagcagccagctcaggctgtcgccgggggggaagatgaacacgctg

SEQ ID NO: 777 - DNA, 48 bp, Artificial Sequence
  Description of Artificial Sequence: Synthetic primer
ctgagctggctgctgagactgctgaacgacgagcagctgaagagcggc

SEQ ID NO: 778 - DNA, 48 bp, Artificial Sequence
  Description of Artificial Sequence: Synthetic primer
tctcagcagccagctcaggctgtcgccgctgggggggaagatgaacac

SEQ ID NO: 779 - DNA, 48 bp, Artificial Sequence
  Description of Artificial Sequence: Synthetic primer
ctgagctggctgctgagactgctgaacgagcagctgaagagcggcacc

SEQ ID NO: 780 - DNA, 49 bp, Artificial Sequence
  Description of Artificial Sequence: Synthetic primer
tctcagcagccagctcaggctgtcgccgtcgctgggggggaagatgaac

SEQ ID NO: 781 - DNA, 45 bp, Artificial Sequence
  Description of Artificial Sequence: Synthetic primer
ctgagctggctgctgagactgctgaacccccgggaggccaaggtg

SEQ ID NO: 782 - DNA, 51 bp, Artificial Sequence
  Description of Artificial Sequence: Synthetic primer
tctcagcagccagctcaggctgtcgccgtagaagttgttcagcaggcacac

SEQ ID NO: 783 - DNA, 47 bp, Artificial Sequence
  Description of Artificial Sequence: Synthetic primer
ctgagctggctgctgagactgctgaaccgggaggccaaggtgcagtg

SEQ ID NO: 784 - DNA, 50 bp, Artificial Sequence
  Description of Artificial Sequence: Synthetic primer
tctcagcagccagctcaggctgtcgccggggtagaagttgttcagcaggc

SEQ ID NO: 785 - DNA, 48 bp, Artificial Sequence
  Description of Artificial Sequence: Synthetic primer
ctgagctggctgctgagactgctgaacgaggccaaggtgcagtggaag

SEQ ID NO: 786 - DNA, 49 bp, Artificial Sequence
  Description of Artificial Sequence: Synthetic primer
tctcagcagccagctcaggctgtcgccccgggggtagaagttgttcagc

SEQ ID NO: 787 - DNA, 48 bp, Artificial Sequence
  Description of Artificial Sequence: Synthetic primer
ctgagctggctgctgagactgctgaacgccaaggtgcagtggaaggtg

SEQ ID NO: 788 - DNA, 49 bp, Artificial Sequence
  Description of Artificial Sequence: Synthetic primer
tctcagcagccagctcaggctgtcgccctcccgggggtagaagttgttc

SEQ ID NO: 789 - DNA, 48 bp, Artificial Sequence
  Description of Artificial Sequence: Synthetic primer
ctgagctggctgctgagactgctgaacaacgccctgcagagcggcaac

SEQ ID NO: 790 - DNA, 49 bp, Artificial Sequence
  Description of Artificial Sequence: Synthetic primer
tctcagcagccagctcaggctgtcgccgtccaccttccactgcaccttg

SEQ ID NO: 791 - DNA, 47 bp, Artificial Sequence
  Description of Artificial Sequence: Synthetic primer
ctgagctggctgctgagactgctgaacgccctgcagagcggcaacag

SEQ ID NO: 792 - DNA, 49 bp, Artificial Sequence
  Description of Artificial Sequence: Synthetic primer
tctcagcagccagctcaggctgtcgccgttgtccaccttccactgcacc

SEQ ID NO: 793 - DNA, 48 bp, Artificial Sequence
  Description of Artificial Sequence: Synthetic primer
ctgagctggctgctgagactgctgaacctgcagagcggcaacagccag

SEQ ID NO: 794 - DNA, 48 bp, Artificial Sequence
  Description of Artificial Sequence: Synthetic primer
tctcagcagccagctcaggctgtcgccggcgttgtccaccttccactg

SEQ ID NO: 795 - DNA, 48 bp, Artificial Sequence
  Description of Artificial Sequence: Synthetic primer
ctgagctggctgctgagactgctgaaccagagcggcaacagccaggag

SEQ ID NO: 796 - DNA, 49 bp, Artificial Sequence
  Description of Artificial Sequence: Synthetic primer
tctcagcagccagctcaggctgtcgcccagggcgttgtccaccttccac

SEQ ID NO: 797 - DNA, 48 bp, Artificial Sequence
  Description of Artificial Sequence: Synthetic primer
ctgagctggctgctgagactgctgaacagcggcaacagccaggagagc

SEQ ID NO: 798 - DNA, 49 bp, Artificial Sequence
  Description of Artificial Sequence: Synthetic primer
tctcagcagccagctcaggctgtcgccctgcagggcgttgtccaccttc

SEQ ID NO: 799 - DNA, 48 bp, Artificial Sequence
  Description of Artificial Sequence: Synthetic primer
ctgagctggctgctgagactgctgaacagcgtcaccgagcaggacagc

SEQ ID NO: 800 - DNA, 48 bp, Artificial Sequence
  Description of Artificial Sequence: Synthetic primer
tctcagcagccagctcaggctgtcgccctcctggctgttgccgctctg

SEQ ID NO: 801 - DNA, 48 bp, Artificial Sequence
  Description of Artificial Sequence: Synthetic primer
ctgagctggctgctgagactgctgaacgtcaccgagcaggacagcaag

SEQ ID NO: 802 - DNA, 47 bp, Artificial Sequence
  Description of Artificial Sequence: Synthetic primer
tctcagcagccagctcaggctgtcgccgctctcctggctgttgccgc

SEQ ID NO: 803 - DNA, 48 bp, Artificial Sequence
  Description of Artificial Sequence: Synthetic primer
ctgagctggctgctgagactgctgaacaccgagcaggacagcaaggac

SEQ ID NO: 804 - DNA, 48 bp, Artificial Sequence
  Description of Artificial Sequence: Synthetic primer
tctcagcagccagctcaggctgtcgccgacgctctcctggctgttgcc

SEQ ID NO: 805 - DNA, 48 bp, Artificial Sequence
  Description of Artificial Sequence: Synthetic primer
ctgagctggctgctgagactgctgaacgagcaggacagcaaggactcc

SEQ ID NO: 806 - DNA, 49 bp, Artificial Sequence
  Description of Artificial Sequence: Synthetic primer
tctcagcagccagctcaggctgtcgccggtgacgctctcctggctgttg

SEQ ID NO: 807 - DNA, 48 bp, Artificial Sequence
  Description of Artificial Sequence: Synthetic primer
ctgagctggctgctgagactgctgaaccaggacagcaaggactccacc

SEQ ID NO: 808 - DNA, 47 bp, Artificial Sequence
  Description of Artificial Sequence: Synthetic primer
tctcagcagccagctcaggctgtcgccctcggtgacgctctcctggc

SEQ ID NO: 809 - DNA, 50 bp, Artificial Sequence
  Description of Artificial Sequence: Synthetic primer
ctgagctggctgctgagactgctgaacgacagcaaggactccacctacag

SEQ ID NO: 810 - DNA, 48 bp, Artificial Sequence
  Description of Artificial Sequence: Synthetic primer
tctcagcagccagctcaggctgtcgccctgctcggtgacgctctcctg

SEQ ID NO: 811 - DNA, 49 bp, Artificial Sequence
  Description of Artificial Sequence: Synthetic primer
ctgagctggctgctgagactgctgaacagcaaggactccacctacagcc

SEQ ID NO: 812 - DNA, 48 bp, Artificial Sequence
  Description of Artificial Sequence: Synthetic primer
tctcagcagccagctcaggctgtcgccgtcctgctcggtgacgctctc

SEQ ID NO: 813 - DNA, 46 bp, Artificial Sequence
  Description of Artificial Sequence: Synthetic primer
ctgagctggctgctgagactgctgaaccaccagggcctgtccagcc

SEQ ID NO: 814 - DNA, 48 bp, Artificial Sequence
  Description of Artificial Sequence: Synthetic primer
tctcagcagccagctcaggctgtcgccggtcacctcgcaggcgtacac

SEQ ID NO: 815 - DNA, 45 bp, Artificial Sequence
  Description of Artificial Sequence: Synthetic primer
ctgagctggctgctgagactgctgaaccagggcctgtccagcccc

SEQ ID NO: 816 - DNA, 46 bp, Artificial Sequence
  Description of Artificial Sequence: Synthetic primer
tctcagcagccagctcaggctgtcgccgtgggtcacctcgcaggcg

SEQ ID NO: 817 - DNA, 45 bp, Artificial Sequence
  Description of Artificial Sequence: Synthetic primer
ctgagctggctgctgagactgctgaacggcctgtccagccccgtg

SEQ ID NO: 818 - DNA, 47 bp, Artificial Sequence
  Description of Artificial Sequence: Synthetic primer
tctcagcagccagctcaggctgtcgccctggtgggtcacctcgcagg

SEQ ID NO: 819 - DNA, 48 bp, Artificial Sequence
  Description of Artificial Sequence: Synthetic primer
ctgagctggctgctgagactgctgaacctgtccagccccgtgaccaag

SEQ ID NO: 820 - DNA, 46 bp, Artificial Sequence
  Description of Artificial Sequence: Synthetic primer
tctcagcagccagctcaggctgtcgccgccctggtgggtcacctcg

SEQ ID NO: 821 - DNA, 48 bp, Artificial Sequence
  Description of Artificial Sequence: Synthetic primer
ctgagctggctgctgagactgctgaactccagccccgtgaccaagagc

SEQ ID NO: 822 - DNA, 46 bp, Artificial Sequence
  Description of Artificial Sequence: Synthetic primer
tctcagcagccagctcaggctgtcgcccaggccctggtgggtcacc

SEQ ID NO: 823 - DNA, 48 bp, Artificial Sequence
  Description of Artificial Sequence: Synthetic primer
ctgagctggctgctgagactgctgaacagccccgtgaccaagagcttc

SEQ ID NO: 824 - DNA, 46 bp, Artificial Sequence
  Description of Artificial Sequence: Synthetic primer
tctcagcagccagctcaggctgtcgccggacaggccctggtgggtc

SEQ ID NO: 825 - DNA, 50 bp, Artificial Sequence
  Description of Artificial Sequence: Synthetic primer
ctgagctggctgctgagactgctgaaccccgtgaccaagagcttcaacag

SEQ ID NO: 826 - DNA, 46 bp, Artificial Sequence
  Description of Artificial Sequence: Synthetic primer
tctcagcagccagctcaggctgtcgccgctggacaggccctggtgg

SEQ ID NO: 827 - DNA, 48 bp, Artificial Sequence
  Description of Artificial Sequence: Synthetic primer
ctgagctggctgctgagactgctgaacagcttcaacaggggcgagtgc

SEQ ID NO: 828 - DNA, 48 bp, Artificial Sequence
  Description of Artificial Sequence: Synthetic primer
tctcagcagccagctcaggctgtcgcccttggtcacggggctggacag

SEQ ID NO: 829 - DNA, 45 bp, Artificial Sequence
  Description of Artificial Sequence: Synthetic primer
ctggagttcatcgccagcaagctggccgtggccgctcccagcgtg

SEQ ID NO: 830 - DNA, 51 bp, Artificial Sequence
  Description of Artificial Sequence: Synthetic primer
cttgctggcgatgaactccaggctgtccgttcgtttgatctccaccttggt

SEQ ID NO: 831 - DNA, 48 bp, Artificial Sequence
  Description of Artificial Sequence: Synthetic primer
ctggagttcatcgccagcaagctggccgccgctcccagcgtgttcatc

SEQ ID NO: 832 - DNA, 52 bp, Artificial Sequence
  Description of Artificial Sequence: Synthetic primer
cttgctggcgatgaactccaggctgtccaccgttcgtttgatctccaccttg

SEQ ID NO: 833 - DNA, 49 bp, Artificial Sequence
  Description of Artificial Sequence: Synthetic primer
ctggagttcatcgccagcaagctggccgctcccagcgtgttcatcttcc

SEQ ID NO: 834 - DNA, 49 bp, Artificial Sequence
  Description of Artificial Sequence: Synthetic primer
cttgctggcgatgaactccaggctgtcggccaccgttcgtttgatctcc

SEQ ID NO: 835 - DNA, 48 bp, Artificial Sequence
  Description of Artificial Sequence: Synthetic primer
ctggagttcatcgccagcaagctggcccccagcgacgagcagctgaag

SEQ ID NO: 836 - DNA, 48 bp, Artificial Sequence
  Description of Artificial Sequence: Synthetic primer
cttgctggcgatgaactccaggctgtcggggaagatgaacacgctggg

SEQ ID NO: 837 - DNA, 48 bp, Artificial Sequence
  Description of Artificial Sequence: Synthetic primer
ctggagttcatcgccagcaagctggccagcgacgagcagctgaagagc

SEQ ID NO: 838 - DNA, 49 bp, Artificial Sequence
  Description of Artificial Sequence: Synthetic primer
cttgctggcgatgaactccaggctgtcgggggggaagatgaacacgctg

SEQ ID NO: 839 - DNA, 48 bp, Artificial Sequence
  Description of Artificial Sequence: Synthetic primer
ctggagttcatcgccagcaagctggccgacgagcagctgaagagcggc

SEQ ID NO: 840 - DNA, 48 bp, Artificial Sequence
  Description of Artificial Sequence: Synthetic primer
cttgctggcgatgaactccaggctgtcgctgggggggaagatgaacac

SEQ ID NO: 841 - DNA, 48 bp, Artificial Sequence
  Description of Artificial Sequence: Synthetic primer
ctggagttcatcgccagcaagctggccgagcagctgaagagcggcacc

SEQ ID NO: 842 - DNA, 49 bp, Artificial Sequence
  Description of Artificial Sequence: Synthetic primer
cttgctggcgatgaactccaggctgtcgtcgctgggggggaagatgaac

SEQ ID NO: 843 - DNA, 45 bp, Artificial Sequence
  Description of Artificial Sequence: Synthetic primer
ctggagttcatcgccagcaagctggccccccgggaggccaaggtg

SEQ ID NO: 844 - DNA, 51 bp, Artificial Sequence
  Description of Artificial Sequence: Synthetic primer
cttgctggcgatgaactccaggctgtcgtagaagttgttcagcaggcacac

SEQ ID NO: 845 - DNA, 47 bp, Artificial Sequence
  Description of Artificial Sequence: Synthetic primer
ctggagttcatcgccagcaagctggcccgggaggccaaggtgcagtg

SEQ ID NO: 846 - DNA, 50 bp, Artificial Sequence
  Description of Artificial Sequence: Synthetic primer
cttgctggcgatgaactccaggctgtcggggtagaagttgttcagcaggc

SEQ ID NO: 847 - DNA, 48 bp, Artificial Sequence
  Description of Artificial Sequence: Synthetic primer
ctggagttcatcgccagcaagctggccgaggccaaggtgcagtggaag

SEQ ID NO: 848 - DNA, 49 bp, Artificial Sequence
  Description of Artificial Sequence: Synthetic primer
cttgctggcgatgaactccaggctgtcccgggggtagaagttgttcagc

SEQ ID NO: 849 - DNA, 48 bp, Artificial Sequence
  Description of Artificial Sequence: Synthetic primer
ctggagttcatcgccagcaagctggccgccaaggtgcagtggaaggtg

SEQ ID NO: 850 - DNA, 49 bp, Artificial Sequence
  Description of Artificial Sequence: Synthetic primer
cttgctggcgatgaactccaggctgtcctcccgggggtagaagttgttc

SEQ ID NO: 851 - DNA, 48 bp, Artificial Sequence
  Description of Artificial Sequence: Synthetic primer
ctggagttcatcgccagcaagctggccaacgccctgcagagcggcaac

SEQ ID NO: 852 - DNA, 49 bp, Artificial Sequence
  Description of Artificial Sequence: Synthetic primer
cttgctggcgatgaactccaggctgtcgtccaccttccactgcaccttg

SEQ ID NO: 853 - DNA, 47 bp, Artificial Sequence
  Description of Artificial Sequence: Synthetic primer
ctggagttcatcgccagcaagctggccgccctgcagagcggcaacag

SEQ ID NO: 854 - DNA, 49 bp, Artificial Sequence
  Description of Artificial Sequence: Synthetic primer
cttgctggcgatgaactccaggctgtcgttgtccaccttccactgcacc

SEQ ID NO: 855 - DNA, 48 bp, Artificial Sequence
  Description of Artificial Sequence: Synthetic primer
ctggagttcatcgccagcaagctggccctgcagagcggcaacagccag

SEQ ID NO: 856 - DNA, 48 bp, Artificial Sequence
  Description of Artificial Sequence: Synthetic primer
cttgctggcgatgaactccaggctgtcggcgttgtccaccttccactg

SEQ ID NO: 857 - DNA, 48 bp, Artificial Sequence
  Description of Artificial Sequence: Synthetic primer
ctggagttcatcgccagcaagctggcccagagcggcaacagccaggag

SEQ ID NO: 858 - DNA, 49 bp, Artificial Sequence
  Description of Artificial Sequence: Synthetic primer
cttgctggcgatgaactccaggctgtccagggcgttgtccaccttccac

SEQ ID NO: 859 - DNA, 48 bp, Artificial Sequence
  Description of Artificial Sequence: Synthetic primer
ctggagttcatcgccagcaagctggccagcggcaacagccaggagagc

SEQ ID NO: 860 - DNA, 49 bp, Artificial Sequence
  Description of Artificial Sequence: Synthetic primer
cttgctggcgatgaactccaggctgtcctgcagggcgttgtccaccttc

SEQ ID NO: 861 - DNA, 48 bp, Artificial Sequence
  Description of Artificial Sequence: Synthetic primer
ctggagttcatcgccagcaagctggccagcgtcaccgagcaggacagc

SEQ ID NO: 862 - DNA, 48 bp, Artificial Sequence
  Description of Artificial Sequence: Synthetic primer
cttgctggcgatgaactccaggctgtcctcctggctgttgccgctctg

SEQ ID NO: 863 - DNA, 48 bp, Artificial Sequence
  Description of Artificial Sequence: Synthetic primer
ctggagttcatcgccagcaagctggccgtcaccgagcaggacagcaag

SEQ ID NO: 864 - DNA, 47 bp, Artificial Sequence
  Description of Artificial Sequence: Synthetic primer
cttgctggcgatgaactccaggctgtcgctctcctggctgttgccgc

SEQ ID NO: 865 - DNA, 48 bp, Artificial Sequence
  Description of Artificial Sequence: Synthetic primer
ctggagttcatcgccagcaagctggccaccgagcaggacagcaaggac

SEQ ID NO: 866 - DNA, 48 bp, Artificial Sequence
  Description of Artificial Sequence: Synthetic primer
cttgctggcgatgaactccaggctgtcgacgctctcctggctgttgcc

SEQ ID NO: 867 - DNA, 48 bp, Artificial Sequence
  Description of Artificial Sequence: Synthetic primer
ctggagttcatcgccagcaagctggccgagcaggacagcaaggactcc

SEQ ID NO: 868 - DNA, 49 bp, Artificial Sequence
  Description of Artificial Sequence: Synthetic primer
cttgctggcgatgaactccaggctgtcggtgacgctctcctggctgttg

SEQ ID NO: 869 - DNA, 48 bp, Artificial Sequence
  Description of Artificial Sequence: Synthetic primer
ctggagttcatcgccagcaagctggcccaggacagcaaggactccacc

SEQ ID NO: 870 - DNA, 47 bp, Artificial Sequence
  Description of Artificial Sequence: Synthetic primer
cttgctggcgatgaactccaggctgtcctcggtgacgctctcctggc

SEQ ID NO: 871 - DNA, 50 bp, Artificial Sequence
  Description of Artificial Sequence: Synthetic primer
ctggagttcatcgccagcaagctggccgacagcaaggactccacctacag

SEQ ID NO: 872 - DNA, 48 bp, Artificial Sequence
  Description of Artificial Sequence: Synthetic primer
cttgctggcgatgaactccaggctgtcctgctcggtgacgctctcctg

SEQ ID NO: 873 - DNA, 49 bp, Artificial Sequence
  Description of Artificial Sequence: Synthetic primer
ctggagttcatcgccagcaagctggccagcaaggactccacctacagcc

SEQ ID NO: 874 - DNA, 48 bp, Artificial Sequence
  Description of Artificial Sequence: Synthetic primer
cttgctggcgatgaactccaggctgtcgtcctgctcggtgacgctctc

SEQ ID NO: 875 - DNA, 46 bp, Artificial Sequence
  Description of Artificial Sequence: Synthetic primer
ctggagttcatcgccagcaagctggcccaccagggcctgtccagcc

SEQ ID NO: 876 - DNA, 48 bp, Artificial Sequence
  Description of Artificial Sequence: Synthetic primer
cttgctggcgatgaactccaggctgtcggtcacctcgcaggcgtacac

SEQ ID NO: 877 - DNA, 45 bp, Artificial Sequence
  Description of Artificial Sequence: Synthetic primer
ctggagttcatcgccagcaagctggcccagggcctgtccagcccc

SEQ ID NO: 878 - DNA, 46 bp, Artificial Sequence
  Description of Artificial Sequence: Synthetic primer
cttgctggcgatgaactccaggctgtcgtgggtcacctcgcaggcg

SEQ ID NO: 879 - DNA, 45 bp, Artificial Sequence
  Description of Artificial Sequence: Synthetic primer
ctggagttcatcgccagcaagctggccggcctgtccagccccgtg

SEQ ID NO: 880 - DNA, 47 bp, Artificial Sequence
  Description of Artificial Sequence: Synthetic primer
cttgctggcgatgaactccaggctgtcctggtgggtcacctcgcagg

SEQ ID NO: 881 - DNA, 48 bp, Artificial Sequence
  Description of Artificial Sequence: Synthetic primer
ctggagttcatcgccagcaagctggccctgtccagccccgtgaccaag

SEQ ID NO: 882 - DNA, 46 bp, Artificial Sequence
  Description of Artificial Sequence: Synthetic primer
cttgctggcgatgaactccaggctgtcgccctggtgggtcacctcg

SEQ ID NO: 883 - DNA, 48 bp, Artificial Sequence
  Description of Artificial Sequence: Synthetic primer
ctggagttcatcgccagcaagctggcctccagccccgtgaccaagagc

SEQ ID NO: 884 - DNA, 46 bp, Artificial Sequence
  Description of Artificial Sequence: Synthetic primer
cttgctggcgatgaactccaggctgtccaggccctggtgggtcacc

SEQ ID NO: 885 - DNA, 48 bp, Artificial Sequence
  Description of Artificial Sequence: Synthetic primer
ctggagttcatcgccagcaagctggccagccccgtgaccaagagcttc

SEQ ID NO: 886 - DNA, 46 bp, Artificial Sequence
  Description of Artificial Sequence: Synthetic primer
cttgctggcgatgaactccaggctgtcggacaggccctggtgggtc

SEQ ID NO: 887 - DNA, 50 bp, Artificial Sequence
  Description of Artificial Sequence: Synthetic primer
ctggagttcatcgccagcaagctggcccccgtgaccaagagcttcaacag

SEQ ID NO: 888 - DNA, 46 bp, Artificial Sequence
  Description of Artificial Sequence: Synthetic primer
cttgctggcgatgaactccaggctgtcgctggacaggccctggtgg

SEQ ID NO: 889 - DNA, 48 bp, Artificial Sequence
  Description of Artificial Sequence: Synthetic primer
ctggagttcatcgccagcaagctggccagcttcaacaggggcgagtgc

SEQ ID NO: 890 - DNA, 48 bp, Artificial Sequence
  Description of Artificial Sequence: Synthetic primer
cttgctggcgatgaactccaggctgtccttggtcacggggctggacag

SEQ ID NO: 891 - DNA, 45 bp, Artificial Sequence
  Description of Artificial Sequence: Synthetic primer
gaaggagatatacatatgaaaatttatgggatttacatggatcgc

SEQ ID NO: 892 - DNA, 44 bp, Artificial Sequence
  Description of Artificial Sequence: Synthetic primer
gtggtggtggtggtggtgcagcaattcttcataggagaccatcg

SEQ ID NO: 893 - DNA, 22 bp, Artificial Sequence
  Description of Artificial Sequence: Synthetic primer
caccaccaccaccaccactgag

SEQ ID NO: 894 - DNA, 41 bp, Artificial Sequence
  Description of Artificial Sequence: Synthetic primer
catatgtatatctccttcttaaagttaaacaaaattatttc

SEQ ID NO: 895 - DNA, 43 bp, Artificial Sequence
  Description of Artificial Sequence: Synthetic primer
gagaacctgtacttccaaggccaccaccaccaccaccactgag

SEQ ID NO: 896 - DNA, 47 bp, Artificial Sequence
  Description of Artificial Sequence: Synthetic primer
gccttggaagtacaggttctccagcaattcttcataggagaccatcg

SEQ ID NO: 897 - DNA, 41 bp, Artificial Sequence
  Description of Artificial Sequence: Synthetic primer
gtctttcatttcaccagaggagcgcgaaaaatgccgtcgct

SEQ ID NO: 898 - DNA, 41 bp, Artificial Sequence
  Description of Artificial Sequence: Synthetic primer
agcgacggcatttttcgcgctcctctggtgaaatgaaagac

SEQ ID NO: 899 - DNA, 39 bp, Artificial Sequence
  Description of Artificial Sequence: Synthetic primer
aaagaagatgctcaccgcgagctgctgggagatgtgctg

SEQ ID NO: 900 - DNA, 39 bp, Artificial Sequence
  Description of Artificial Sequence: Synthetic primer
cagcacatctcccagcagctcgcggtgagcatcttcttt

SEQ ID NO: 901 - DNA, 42 bp, Artificial Sequence
  Description of Artificial Sequence: Synthetic primer
gcaggaatatggcaaaccgtatattccagatcttccagatgc

SEQ ID NO: 902 - DNA, 42 bp, Artificial Sequence
  Description of Artificial Sequence: Synthetic primer
gcatctggaagatctggaatatacggtttgccatattcctgc

SEQ ID NO: 903 - DNA, 60 bp, Artificial Sequence
  Description of Artificial Sequence: Synthetic primer
aataattttgtttaactttaagaaggagatatacatatggcaatattaggtttaggcacg

SEQ ID NO: 904 - DNA, 47 bp, Artificial Sequence
  Description of Artificial Sequence: Synthetic primer
cagtggtggtggtggtggtgactttcaataattaccgtggcacaagc

SEQ ID NO: 905 - DNA, 20 bp, Artificial Sequence
  Description of Artificial Sequence: Synthetic primer
caccaccaccaccaccactg

SEQ ID NO: 906 - DNA, 36 bp, Artificial Sequence
  Description of Artificial Sequence: Synthetic primer
atgtatatctccttcttaaagttaaacaaaattatt

SEQ ID NO: 907 - DNA, 50 bp, Artificial Sequence
  Description of Artificial Sequence: Synthetic primer
ctggagttcatcgccagcaagctggccaagggccgtttcactataagcgc

SEQ ID NO: 908 - DNA, 54 bp, Artificial Sequence
  Description of Artificial Sequence: Synthetic primer
cttgctggcgatgaactccaggctatcggcatatctagtataaccattcgtagg

SEQ ID NO: 909 - DNA, 51 bp, Artificial Sequence
  Description of Artificial Sequence: Synthetic primer
gacagcctggagttcatcgccagcaaggtcaagggccgtttcactataagc

SEQ ID NO: 910 - DNA, 54 bp, Artificial Sequence
  Description of Artificial Sequence: Synthetic primer
cttgctggcgatgaactccaggctgtcggcatatctagtataaccattcgtagg

SEQ ID NO: 911 - DNA, 51 bp, Artificial Sequence
  Description of Artificial Sequence: Synthetic primer
gacagcctggagttcatcgccagcaagggccgtttcactataagcgcagac

SEQ ID NO: 912 - DNA, 54 bp, Artificial Sequence; identical to SEQ ID NO: 910
  Description of Artificial Sequence: Synthetic primer

SEQ ID NO: 913 - DNA, 54 bp, Artificial Sequence
  Description of Artificial Sequence: Synthetic primer
ctggagttcatcgccagcaagctggcccagccggaagacttcgcaacttattac

SEQ ID NO: 914 - DNA, 50 bp, Artificial Sequence
  Description of Artificial Sequence: Synthetic primer
cttgctggcgatgaactccaggctgtcgatggtcagagtgaaatccgtcc

SEQ ID NO: 915 - DNA, 49 bp, Artificial Sequence
  Description of Artificial Sequence: Synthetic primer
ctgagctggctgctgagactgctgaactgcctggtgaaggactacttcc

SEQ ID NO: 916 - DNA, 43 bp, Artificial Sequence
  Description of Artificial Sequence: Synthetic primer
tctcagcagccagctcaggctgtcgccgctgggggccaggggg

SEQ ID NO: 917 - DNA, 45 bp, Artificial Sequence
  Description of Artificial Sequence: Synthetic primer
ctgagctggctgctgagactgctgaacacagccgccctgggctgc

SEQ ID NO: 918 - DNA, 44 bp, Artificial Sequence
  Description of Artificial Sequence: Synthetic primer
tctcagcagccagctcaggctgtcgccgctgctgggggccaggg

SEQ ID NO: 919 - DNA, 39 bp, Artificial Sequence
  Description of Artificial Sequence: Synthetic primer
ggcgacagcctgagctggctggccctgggctgcctggtg

SEQ ID NO: 920 - DNA, 40 bp, Artificial Sequence
  Description of Artificial Sequence: Synthetic primer
cagccagctcaggctgtcgcccttgctgctgggggccagg

SEQ ID NO: 921 - DNA, 33 bp, Artificial Sequence
  Description of Artificial Sequence: Synthetic primer
ctgagactgctgaacgccctgggctgcctggtg

SEQ ID NO: 922 - DNA, 35 bp, Artificial Sequence
  Description of Artificial Sequence: Synthetic primer
gttcagcagtctcagcagccagctcaggctgtcgc

SEQ ID NO: 923 - DNA, 45 bp, Artificial Sequence
  Description of Artificial Sequence: Synthetic primer
ctgagctggctgctgagactgctgaacgccgccctgggctgcctg

SEQ ID NO: 924 - DNA, 46 bp, Artificial Sequence
  Description of Artificial Sequence: Synthetic primer
tctcagcagccagctcaggctgtcgccgctcttgctgctgggggcc

SEQ ID NO: 925 - DNA, 42 bp, Artificial Sequence
  Description of Artificial Sequence: Synthetic primer
ggcgacagcctgagctggctgacctgtctggtgaagggcttc

SEQ ID NO: 926 - DNA, 40 bp, Artificial Sequence
  Description of Artificial Sequence: Synthetic primer
cagccagctcaggctgtcgcccatctcctcccgggagggg

SEQ ID NO: 927 - DNA, 39 bp, Artificial Sequence
  Description of Artificial Sequence: Synthetic primer
ggcgacagcctgagctggctgacagccgccctgggctgc

SEQ ID NO: 928 - DNA, 37 bp, Artificial Sequence
  Description of Artificial Sequence: Synthetic primer
cagccagctcaggctgtcgccgctgggggccaggggg

SEQ ID NO: 929 - DNA, 49 bp, Artificial Sequence
  Description of Artificial Sequence: Synthetic primer
ctgagctggctgctgagactgctgaacgtgaaggactacttccccgagc

SEQ ID NO: 930 - DNA, 46 bp, Artificial Sequence
  Description of Artificial Sequence: Synthetic primer
tctcagcagccagctcaggctgtcgcccttgctgctgggggccagg

SEQ ID NO: 931 - DNA, 44 bp, Artificial Sequence
  Description of Artificial Sequence: Synthetic primer
ggcgacagcctgagctggctgtgcaacgtgaaccacaagcccag

SEQ ID NO: 932 - DNA, 40 bp, Artificial Sequence
  Description of Artificial Sequence: Synthetic primer
cagccagctcaggctgtcgccgctgctgctgggcactgtc

SEQ ID NO: 933 - DNA, 38 bp, Artificial Sequence
  Description of Artificial Sequence: Synthetic primer
ctgagactgctgaactgcaacgtgaaccacaagcccag

SEQ ID NO: 934 - DNA, 35 bp, Artificial Sequence; identical to SEQ ID NO: 922
  Description of Artificial Sequence: Synthetic primer

SEQ ID NO: 935 - DNA, 49 bp, Artificial Sequence
  Description of Artificial Sequence: Synthetic primer
ctgagctggctgctgagactgctgaacaagcccagcaacaccaaggtgg

SEQ ID NO: 936 - DNA, 46 bp, Artificial Sequence
  Description of Artificial Sequence: Synthetic primer
tctcagcagccagctcaggctgtcgccgctgctgctgggcactgtc

SEQ ID NO: 937 - DNA, 43 bp, Artificial Sequence
  Description of Artificial Sequence: Synthetic primer
ggcgacagcctgagctggctgtccctgacctgtctggtgaagg

SEQ ID NO: 938 - DNA, 37 bp, Artificial Sequence
  Description of Artificial Sequence: Synthetic primer
cagccagctcaggctgtcgccctcccgggaggggggc

SEQ ID NO: 939 - DNA, 46 bp, Artificial Sequence
  Description of Artificial Sequence: Synthetic primer
ggcgacagcctgagctggctgaacaactacaagaccacacctccag

SEQ ID NO: 940 - DNA, 40 bp, Artificial Sequence
  Description of Artificial Sequence: Synthetic primer
cagccagctcaggctgtcgccctcgggctggccgttgctc

SEQ ID NO: 941 - DNA, 44 bp, Artificial Sequence
  Description of Artificial Sequence: Synthetic primer
gcgacagcctgagctggctgcagacctacatctgcaacgtgaac

SEQ ID NO: 942 - DNA, 42 bp, Artificial Sequence
  Description of Artificial Sequence: Synthetic primer
cagccagctcaggctgtcgcccactgtcaccacgctggacag

SEQ ID NO: 943 - DNA, 51 bp, Artificial Sequence
  Description of Artificial Sequence: Synthetic primer
ctgagctggctgctgagactgctgaacaacgtgaaccacaagcccagcaac

SEQ ID NO: 944 - DNA, 48 bp, Artificial Sequence
  Description of Artificial Sequence: Synthetic primer
tctcagcagccagctcaggctgtcgcccactgtcaccacgctggacag

SEQ ID NO: 945 - DNA, 51 bp, Artificial Sequence
  Description of Artificial Sequence: Synthetic primer
ctgagctggctgctgagactgctgaacttcctgtacagcaagctgaccgtg

SEQ ID NO: 946 - DNA, 49 bp, Artificial Sequence
  Description of Artificial Sequence: Synthetic primer
tctcagcagccagctcaggctgtcgcccactggaggtgtggtcttgtag

SEQ ID NO: 947 - DNA, 39 bp, Artificial Sequence
  Description of Artificial Sequence: Synthetic primer
ctgagactgctgaaccagacctacatctgcaacgtgaac

SEQ ID NO: 948 - DNA, 35 bp, Artificial Sequence; identical to SEQ ID NO: 922
  Description of Artificial Sequence: Synthetic primer

SEQ ID NO: 949 - DNA, 50 bp, Artificial Sequence
  Description of Artificial Sequence: Synthetic primer
ctggagttcatcgccagcaagctggcctgcaacgtgaaccacaagcccag

SEQ ID NO: 950 - DNA, 48 bp, Artificial Sequence
  Description of Artificial Sequence: Synthetic primer
cttgctggcgatgaactccaggctgtccactgtcaccacgctggacag

SEQ ID NO: 951 - DNA, 52 bp, Artificial Sequence
  Description of Artificial Sequence: Synthetic primer
ctgagctggctgctgagactgctgaactacatctgcaacgtgaaccacaagc

SEQ ID NO: 952 - DNA, 47 bp, Artificial Sequence; identical to SEQ ID NO: 402
  Description of Artificial Sequence: Synthetic primer

SEQ ID NO: 953 - DNA, 51 bp, Artificial Sequence
  Description of Artificial Sequence: Synthetic primer
ctggagttcatcgccagcaagctggccaacgtgaaccacaagcccagcaac

SEQ ID NO: 954 - DNA, 47 bp, Artificial Sequence; identical to SEQ ID NO: 608
  Description of Artificial Sequence: Synthetic primer

SEQ ID NO: 955 - DNA, 49 bp, Artificial Sequence
  Description of Artificial Sequence: Synthetic primer
agcctgagctggctgctgagactgctgttcagctgcagcgtgatgcacg

SEQ ID NO: 956 - DNA, 49 bp, Artificial Sequence
  Description of Artificial Sequence: Synthetic primer
cagcagtctcagcagccagctcaggctgtccacggtcagcttgctgtac

SEQ ID NO: 957 - DNA, 49 bp, Artificial Sequence
  Description of Artificial Sequence: Synthetic primer
agcctggagttcatcgccagcaagctgttcagctgcagcgtgatgcacg

SEQ ID NO: 958 - DNA, 49 bp, Artificial Sequence
  Description of Artificial Sequence: Synthetic primer
cagcttgctggcgatgaactccaggctgtccacggtcagcttgctgtac

SEQ ID NO: 959 - DNA, 46 bp, Artificial Sequence
  Description of Artificial Sequence: Synthetic primer
gacagcctggagttcatcgccaacaactacaagaccacacctccag

SEQ ID NO: 960 - DNA, 41 bp, Artificial Sequence
  Description of Artificial Sequence: Synthetic primer
ggcgatgaactccaggctgtcccactccacggcgatgtcgc

SEQ ID NO: 961 - DNA, 46 bp, Artificial Sequence
  Description of Artificial Sequence: Synthetic primer
gacagcctgagctggctgctgaacaactacaagaccacacctccag

SEQ ID NO: 962 - DNA, 41 bp, Artificial Sequence
  Description of Artificial Sequence: Synthetic primer
cagcagccagctcaggctgtcccactccacggcgatgtcgc

SEQ ID NO: 963 - DNA, 47 bp, Artificial Sequence
  Description of Artificial Sequence: Synthetic primer
ctgagctggctgctgagactgctgaaccagctggtggagtctggcgg

SEQ ID NO: 964 - DNA, 48 bp, Artificial Sequence
  Description of Artificial Sequence: Synthetic primer
tctcagcagccagctcaggctgtcgccaacctcagcagtggcaccggg

SEQ ID NO: 965 - DNA, 48 bp, Artificial Sequence
  Description of Artificial Sequence: Synthetic primer
ctgagctggctgctgagactgctgaaccagatgacccagtccccgagc

SEQ ID NO: 966 - DNA, 54 bp, Artificial Sequence
  Description of Artificial Sequence: Synthetic primer
ctgagctggctgctgagactgctgaactaatctagacacctcagacaatcaacc

SEQ ID NO: 967 - DNA, 47 bp, Artificial Sequence
  Description of Artificial Sequence: Synthetic primer
tctcagcagccagctcaggctgtcgccgcactcgcccctgttgaagc

SEQ ID NO: 968 - DNA, 47 bp, Artificial Sequence
  Description of Artificial Sequence: Synthetic primer
ctggagttcatcgccagcaagctggcccagatgacccagtccccgag

SEQ ID NO: 969 - DNA, 48 bp, Artificial Sequence
  Description of Artificial Sequence: Synthetic primer
cttgctggcgatgaactccaggctgtcgatatcagcagtggcaccggg

SEQ ID NO: 970 - DNA, 54 bp, Artificial Sequence
  Description of Artificial Sequence: Synthetic primer
ctggagttcatcgccagcaagctggcctaatctagacacctcagacaatcaacc

SEQ ID NO: 971 - DNA, 47 bp, Artificial Sequence
  Description of Artificial Sequence: Synthetic primer
cttgctggcgatgaactccaggctgtcgcactcgcccctgttgaagc

SEQ ID NO: 972 - DNA, 47 bp, Artificial Sequence
  Description of Artificial Sequence: Synthetic primer
ctggagttcatcgccagcaagctggcccagctggtggagtctggcgg

SEQ ID NO: 973 - DNA, 47 bp, Artificial Sequence
  Description of Artificial Sequence: Synthetic primer
cttgctggcgatgaactccaggctgtcaacctcagcagtggcaccgg

SEQ ID NO: 974 - DNA, 54 bp, Artificial Sequence; identical to SEQ ID NO: 966
  Description of Artificial Sequence: Synthetic primer

SEQ ID NO: 975 - DNA, 46 bp, Artificial Sequence
  Description of Artificial Sequence: Synthetic primer
tctcagcagccagctcaggctgtcgcccttgccgggggacaggctc

SEQ ID NO: 976 - DNA, 54 bp, Artificial Sequence; identical to SEQ ID NO: 970
  Description of Artificial Sequence: Synthetic primer

SEQ ID NO: 977 - DNA, 46 bp, Artificial Sequence
  Description of Artificial Sequence: Synthetic primer
cttgctggcgatgaactccaggctgtccttgccgggggacaggctc

SEQ ID NO: 978 - DNA, 48 bp, Artificial Sequence
  Description of Artificial Sequence: Synthetic primer
ctggagttcatcgccagcaagctggccggctgcctggtgaaggactac

SEQ ID NO: 979 - DNA, 43 bp, Artificial Sequence
  Description of Artificial Sequence: Synthetic primer
cttgctggcgatgaactccaggctgtcgctgggggccaggggg

SEQ ID NO: 980 - DNA, 50 bp, Artificial Sequence
  Description of Artificial Sequence: Synthetic primer
agcctggagttcatcgccagcaagctgtgcaacgtgaaccacaagcccag

SEQ ID NO: 981 - DNA, 47 bp, Artificial Sequence; identical to SEQ ID NO: 608
  Description of Artificial Sequence: Synthetic primer

SEQ ID NO: 982 - DNA, 50 bp, Artificial Sequence
  Description of Artificial Sequence: Synthetic primer
gacagcctggagttcatcgccagcaagtgcaacgtgaaccacaagcccag

SEQ ID NO: 983 - DNA, 47 bp, Artificial Sequence; identical to SEQ ID NO: 610
  Description of Artificial Sequence: Synthetic primer

SEQ ID NO: 984 - DNA, 50 bp, Artificial Sequence
  Description of Artificial Sequence: Synthetic primer
ctggagttcatcgccagcaagctggccaagctgaccgtggacaagtccag

SEQ ID NO: 985 - DNA, 49 bp, Artificial Sequence
  Description of Artificial Sequence: Synthetic primer
cttgctggcgatgaactccaggctgtccactggaggtgtggtcttgtag

SEQ ID NO: 986 - DNA, 52 bp, Artificial Sequence
  Description of Artificial Sequence: Synthetic primer
gacagcctggagttcatcgccagcaagaacaactacaagaccacacctccag

SEQ ID NO: 987 - DNA, 46 bp, Artificial Sequence; identical to SEQ ID NO: 726
  Description of Artificial Sequence: Synthetic primer

SEQ ID NO: 988 - DNA, 52 bp, Artificial Sequence
  Description of Artificial Sequence: Synthetic primer
agcctggagttcatcgccagcaagctgaacaactacaagaccacacctccag

SEQ ID NO: 989 - DNA, 46 bp, Artificial Sequence; identical to SEQ ID NO: 726
  Description of Artificial Sequence: Synthetic primer

SEQ ID NO: 990 - DNA, 24 bp, Artificial Sequence
  Description of Artificial Sequence: Synthetic primer
gagaacctgtacttccaaggccac

SEQ ID NO: 991 - DNA, 38 bp, Artificial Sequence
  Description of Artificial Sequence: Synthetic primer
atgtatatctccttcttaaagttaaacaaaattatttc

SEQ ID NO: 992 - DNA, 22 bp, Artificial Sequence
  Description of Artificial Sequence: Synthetic primer
caccaccaccaccaccactgag

SEQ ID NO: 993 - DNA, 45 bp, Artificial Sequence
  Description of Artificial Sequence: Synthetic primer
ttggaagtacaggttctcacgttcgcagaggaatttacacacttc

SEQ ID NO: 994 - DNA, 45 bp, Artificial Sequence
  Description of Artificial Sequence: Synthetic primer
taagaaggagatatacatatgggttttctgccgaaagagaaaaag

SEQ ID NO: 995 - DNA, 50 bp, Artificial Sequence
  Description of Artificial Sequence: Synthetic primer
gtggtggtggtggtggtggctattatttttaatatattcaacgacgtcgc

SEQ ID NO: 996 - DNA, 47 bp, Artificial Sequence
  Description of Artificial Sequence: Synthetic primer
taagaaggagatatacatatgttcgagaaagtccgtaaaatcattgc

SEQ ID NO: 997 - DNA, 42 bp, Artificial Sequence
  Description of Artificial Sequence: Synthetic primer
gtggtggtggtggtggtgcgcctggtggccgttgatgtaatc

SEQ ID NO: 998 - DNA, 45 bp, Artificial Sequence
  Description of Artificial Sequence: Synthetic primer
taagaaggagatatacatatgagcactatcgaagaacgcgttaag

SEQ ID NO: 999 - DNA, 52 bp, Artificial Sequence
  Description of Artificial Sequence: Synthetic primer
ctggacatgctggagtggagcctgatgaacaactacaagaccacacctccag

SEQ ID NO: 1000 - DNA, 46 bp, Artificial Sequence
  Description of Artificial Sequence: Synthetic primer
ccactccagcatgtccaggctgtcgccctcgggctggccgttgctc

SEQ ID NO: 1001 - DNA, 47 bp, Artificial Sequence
  Description of Artificial Sequence: Synthetic primer
ctggacatgctggagtggagcctgatgcagctggtggagtctggcgg

SEQ ID NO: 1002 - DNA, 47 bp, Artificial Sequence
  Description of Artificial Sequence: Synthetic primer
ccactccagcatgtccaggctgtcgccaacctcagcagtggcaccgg

SEQ ID NO: 1003 - DNA, 50 bp, Artificial Sequence
  Description of Artificial Sequence: Synthetic primer
ctgagctggctgctgagactgctgaacaagaaccaggtcagcctgacctg

SEQ ID NO: 1004 - DNA, 47 bp, Artificial Sequence
  Description of Artificial Sequence: Synthetic primer
tctcagcagccagctcaggctgtcgccggtcatctcctcccgggatg

SEQ ID NO: 1005 - DNA, 51 bp, Artificial Sequence
  Description of Artificial Sequence: Synthetic primer
ctgagctggctgctgagactgctgaacaacaactacaagaccacgcctccc

SEQ ID NO: 1006 - DNA, 48 bp, Artificial Sequence
  Description of Artificial Sequence: Synthetic primer
tctcagcagccagctcaggctgtcgccctccggctgcccattgctctc

SEQ ID NO: 1007 - DNA, 50 bp, Artificial Sequence
  Description of Artificial Sequence: Synthetic primer
ctgagctggctgctgagactgctgaacaacagcacctacagggtggtgtc

SEQ ID NO: 1008 - DNA, 48 bp, Artificial Sequence
  Description of Artificial Sequence: Synthetic primer
ctgagctggctgctgagactgctgaacagcacctacagggtggtgtcc

SEQ ID NO: 1009 - DNA, 50 bp, Artificial Sequence
  Description of Artificial Sequence: Synthetic primer
ctggagttcatcgccagcaagctggccaacagcacctacagggtggtgtc

SEQ ID NO: 1010 - DNA, 48 bp, Artificial Sequence
  Description of Artificial Sequence: Synthetic primer
ctggagttcatcgccagcaagctggccagcacctacagggtggtgtcc

SEQ ID NO: 1011 - DNA, 28 bp, Artificial Sequence
  Description of Artificial Sequence: Synthetic primer
gcccgagggcgacgccctgagctggctg

SEQ ID NO: 1012 - DNA, 42 bp, Artificial Sequence
  Description of Artificial Sequence: Synthetic primer
catcaccatcaccatcacgttttccctgccaaacggttctgc

SEQ ID NO: 1013 - DNA, 25 bp, Artificial Sequence
  Description of Artificial Sequence: Synthetic primer
taagtctagagggcccgtttaaacc

SEQ ID NO: 1014 - DNA, 42 bp, Artificial Sequence
  Description of Artificial Sequence: Synthetic primer
ggtgccactgctcagcctgttttccctgccaaacggttctgc

SEQ ID NO: 1015 - DNA, 27 bp, Artificial Sequence
  Description of Artificial Sequence: Synthetic primer
catcaccatcaccatcactaagtctag

SEQ ID NO: 1016 - DNA, 25 bp, Artificial Sequence
  Description of Artificial Sequence: Synthetic primer
atgatagtcggtgtgggtattgatg

SEQ ID NO: 1017 - protein, 4 aa, Artificial Sequence
  Description of Artificial Sequence: Synthetic peptide
AMKM

SEQ ID NO: 1018 - protein, 9 aa, Artificial Sequence
  Description of Artificial Sequence: Synthetic peptide
SSKSTSGGT

SEQ ID NO: 1019 - protein, 9 aa, Artificial Sequence
  Description of Artificial Sequence: Synthetic peptide
CSRSTSEST

SEQ ID NO: 1020 - protein, 9 aa, Artificial Sequence
  Description of Artificial Sequence: Synthetic peptide
CSRSTSGGT

SEQ ID NO: 1021 - protein, 8 aa, Artificial Sequence
  Description of Artificial Sequence: Synthetic peptide
NSGALTSG

SEQ ID NO: 1022 - protein, 9 aa, Artificial Sequence
  Description of Artificial Sequence: Synthetic peptide
PSSSLGTQT

SEQ ID NO: 1023 - protein, 9 aa, Artificial Sequence
  Description of Artificial Sequence: Synthetic peptide
PSSNFGTQT

SEQ ID NO: 1024 - protein, 9 aa, Artificial Sequence
  Description of Artificial Sequence: Synthetic peptide
PSSSLGTKT

SEQ ID NO: 1025 - protein, 4 aa, Artificial Sequence
  Description of Artificial Sequence: Synthetic peptide
KPSN

SEQ ID NO: 1026 - protein, 8 aa, Artificial Sequence
  Description of Artificial Sequence: Synthetic peptide
PAPELLGG

SEQ ID NO: 1027 - protein, 7 aa, Artificial Sequence
  Description of Artificial Sequence: Synthetic peptide
PAPPVAG

SEQ ID NO: 1028 - protein, 8 aa, Artificial Sequence
  Description of Artificial Sequence: Synthetic peptide
PAPEFLGG

SEQ ID NO: 1029 - protein, 6 aa, Artificial Sequence
  Description of Artificial Sequence: Synthetic peptide
ISRTPE

SEQ ID NO: 1030 - protein, 6 aa, Artificial Sequence
  Description of Artificial Sequence: Synthetic peptide
SHEDPE

SEQ ID NO: 1031 - protein, 6 aa, Artificial Sequence
  Description of Artificial Sequence: Synthetic peptide
SQEDPE

SEQ ID NO: 1032 - protein, 5 aa, Artificial Sequence
  Description of Artificial Sequence: Synthetic peptide
QYNST

SEQ ID NO: 1033 - protein, 5 aa, Artificial Sequence
  Description of Artificial Sequence: Synthetic peptide
QFNST

SEQ ID NO: 1034 - protein, 5 aa, Artificial Sequence
  Description of Artificial Sequence: Synthetic peptide
TVLHQ

SEQ ID NO: 1035 - protein, 5 aa, Artificial Sequence
  Description of Artificial Sequence: Synthetic peptide
TVVHQ

SEQ ID NO: 1036 - protein, 4 aa, Artificial Sequence
  Description of Artificial Sequence: Synthetic peptide
NGKE

SEQ ID NO: 1037 - protein, 6 aa, Artificial Sequence
  Description of Artificial Sequence: Synthetic peptide
KALPAP

SEQ ID NO: 1038 - protein, 6 aa, Artificial Sequence
  Description of Artificial Sequence: Synthetic peptide
KGLPAP

SEQ ID NO: 1039 - protein, 6 aa, Artificial Sequence
  Description of Artificial Sequence: Synthetic peptide
KGLPSS

SEQ ID NO: 1040 - protein, 7 aa, Artificial Sequence
  Description of Artificial Sequence: Synthetic peptide
AKGQPRE

SEQ ID NO: 1041 - protein, 7 aa, Artificial Sequence
  Description of Artificial Sequence: Synthetic peptide
TKGQPRE

SEQ ID NO: 1042 - protein, 7 aa, Artificial Sequence
  Description of Artificial Sequence: Synthetic peptide
  MOD_RES (2)..(2): Asp or Glu
  MOD_RES (4)..(4): Leu or Met
RXEXTKN

SEQ ID NO: 1043 - protein, 7 aa, Artificial Sequence
  Description of Artificial Sequence: Synthetic peptide
REEMTKN

SEQ ID NO: 1044 - protein, 7 aa, Artificial Sequence
  Description of Artificial Sequence: Synthetic peptide
QEEMTKN

SEQ ID NO: 1045 - protein, 4 aa, Artificial Sequence
  Description of Artificial Sequence: Synthetic peptide
DSDG

SEQ ID NO: 1046 - protein, 8 aa, Artificial Sequence
  Description of Artificial Sequence: Synthetic peptide
SRWQQGNV

SEQ ID NO: 1047 - protein, 8 aa, Artificial Sequence
  Description of Artificial Sequence: Synthetic peptide
SRWQQGNI

SEQ ID NO: 1048 - protein, 8 aa, Artificial Sequence
  Description of Artificial Sequence: Synthetic peptide
SRWQEGNV

SEQ ID NO: 1049 - protein, 5 aa, Artificial Sequence
  Description of Artificial Sequence: Synthetic peptide
SLSPG

SEQ ID NO: 1050 - protein, 5 aa, Artificial Sequence
  Description of Artificial Sequence: Synthetic peptide
SLSLG

SEQ ID NO: 1051 - protein, 4 aa, Artificial Sequence
  Description of Artificial Sequence: Synthetic peptide
TVAA

SEQ ID NO: 1052 - protein, 5 aa, Artificial Sequence
  Description of Artificial Sequence: Synthetic peptide
PPSDE

SEQ ID NO: 1053 - protein, 5 aa, Artificial Sequence
  Description of Artificial Sequence: Synthetic peptide
YPREA

SEQ ID NO: 1054 - protein, 6 aa, Artificial Sequence
  Description of Artificial Sequence: Synthetic peptide
DNALQS

SEQ ID NO: 1055 - protein, 8 aa, Artificial Sequence
  Description of Artificial Sequence: Synthetic peptide
ESVTEQDS

SEQ ID NO: 1056 - protein, 8 aa, Artificial Sequence
  Description of Artificial Sequence: Synthetic peptide
THQGLSSP

SEQ ID NO: 1057 - protein, 5 aa, Artificial Sequence
  Description of Artificial Sequence: Synthetic peptide
  MOD_RES (3)..(3): Any amino acid
LPXTG

SEQ ID NO: 1058 - protein, 5 aa, Artificial Sequence
  Description of Artificial Sequence: Synthetic peptide
  MOD_RES (2)..(2): Any amino acid
  MOD_RES (4)..(4): Any amino acid
CXPXR

SEQ ID NO: 1059 - protein, 9 aa, Artificial Sequence
  Description of Artificial Sequence: Synthetic peptide
  MOD_RES (2)..(2): Any amino acid
  MOD_RES (5)..(6): Any amino acid
DXFFXXLGG

SEQ ID NO: 1060 - protein, 4 aa, Artificial Sequence
  Description of Artificial Sequence: Synthetic peptide
RLLN

SEQ ID NO: 1061 - DNA, 46 bp, Artificial Sequence
  Description of Artificial Sequence: Synthetic primer
ctgagctggctgctgagactgctgaacagcaccaagggccccagcg

SEQ ID NO: 1062 - DNA, 48 bp, Artificial Sequence
  Description of Artificial Sequence: Synthetic primer
tctcagcagccagctcaggctgtcgccagccgaggagacggtgaccag

SEQ ID NO: 1063 - DNA, 48 bp, Artificial Sequence
  Description of Artificial Sequence: Synthetic primer
ctgagctggctgctgagactgctgaacaccaagggccccagcgtgttc

SEQ ID NO: 1064 - DNA, 48 bp, Artificial Sequence
  Description of Artificial Sequence: Synthetic primer
tctcagcagccagctcaggctgtcgccgctagccgaggagacggtgac

SEQ ID NO: 1065 - DNA, 47 bp, Artificial Sequence
  Description of Artificial Sequence: Synthetic primer
ctgagctggctgctgagactgctgaacaagggccccagcgtgttccc

SEQ ID NO: 1066 - DNA, 47 bp, Artificial Sequence
  Description of Artificial Sequence: Synthetic primer
tctcagcagccagctcaggctgtcgccggtgctagccgaggagacgg

SEQ ID NO: 1067 - DNA, 47 bp, Artificial Sequence
  Description of Artificial Sequence: Synthetic primer
ctgagctggctgctgagactgctgaacagcaagagcaccagcggcgg

SEQ ID NO: 1068 - DNA, 46 bp, Artificial Sequence
  Description of Artificial Sequence: Synthetic primer
tctcagcagccagctcaggctgtcgccgctgggggccagggggaac

SEQ ID NO: 1069 - DNA, 47 bp, Artificial Sequence
  Description of Artificial Sequence: Synthetic primer
ctgagctggctgctgagactgctgaacaagagcaccagcggcggcac

SEQ ID NO: 1070 - DNA, 45 bp, Artificial Sequence
  Description of Artificial Sequence: Synthetic primer
tctcagcagccagctcaggctgtcgccgctgctgggggccagggg

SEQ ID NO: 1071 - DNA, 46 bp, Artificial Sequence
  Description of Artificial Sequence: Synthetic primer
ctgagctggctgctgagactgctgaacagcaccagcggcggcacag

SEQ ID NO: 1072 - DNA, 46 bp, Artificial Sequence; identical to SEQ ID NO: 930
  Description of Artificial Sequence: Synthetic primer

SEQ ID NO: 1073 - DNA, 45 bp, Artificial Sequence
  Description of Artificial Sequence: Synthetic primer
ctgagctggctgctgagactgctgaacaccagcggcggcacagcc

SEQ ID NO: 1074 - DNA, 46 bp, Artificial Sequence; identical to SEQ ID NO: 924
  Description of Artificial Sequence: Synthetic primer

SEQ ID NO: 1075 - DNA, 45 bp, Artificial Sequence
  Description of Artificial Sequence: Synthetic primer
ctgagctggctgctgagactgctgaacagcggcggcacagccgcc

SEQ ID NO: 1076 - DNA, 47 bp, Artificial Sequence
  Description of Artificial Sequence: Synthetic primer
tctcagcagccagctcaggctgtcgccggtgctcttgctgctggggg

SEQ ID NO: 1077 - DNA, 45 bp, Artificial Sequence
  Description of Artificial Sequence: Synthetic primer
ctgagctggctgctgagactgctgaacggcggcacagccgccctg

SEQ ID NO: 1078 - DNA, 48 bp, Artificial Sequence
  Description of Artificial Sequence: Synthetic primer
tctcagcagccagctcaggctgtcgccgctggtgctcttgctgctggg

SEQ ID NO: 1079 - DNA, 45 bp, Artificial Sequence
  Description of Artificial Sequence: Synthetic primer
ctgagctggctgctgagactgctgaacggcacagccgccctgggc

SEQ ID NO: 1080 - DNA, 47 bp, Artificial Sequence
  Description of Artificial Sequence: Synthetic primer
tctcagcagccagctcaggctgtcgccgccgctggtgctcttgctgc

SEQ ID NO: 1081 - DNA, 45 bp, Artificial Sequence; identical to SEQ ID NO: 917
  Description of Artificial Sequence: Synthetic primer

SEQ ID NO: 1082 - DNA, 46 bp, Artificial Sequence
  Description of Artificial Sequence: Synthetic primer
tctcagcagccagctcaggctgtcgccgccgccgctggtgctcttg

SEQ ID NO: 1083 - DNA, 48 bp, Artificial Sequence
  Description of Artificial Sequence: Synthetic primer
ctgagctggctgctgagactgctgaaccccgtgaccgtgtcctggaac

SEQ ID NO: 1084 - DNA, 49 bp, Artificial Sequence
  Description of Artificial Sequence: Synthetic primer
tctcagcagccagctcaggctgtcgccctcggggaagtagtccttcacc

SEQ ID NO: 1085 - DNA, 49 bp, Artificial Sequence
  Description of Artificial Sequence: Synthetic primer
ctgagctggctgctgagactgctgaacgtgaccgtgtcctggaacagcg

SEQ ID NO: 1086 - DNA, 49 bp, Artificial Sequence
  Description of Artificial Sequence: Synthetic primer
tctcagcagccagctcaggctgtcgccgggctcggggaagtagtccttc

SEQ ID NO: 1087 - DNA, 46 bp, Artificial Sequence
  Description of Artificial Sequence: Synthetic primer
ctgagctggctgctgagactgctgaacagcggagccctgacctccg

SEQ ID NO: 1088 - DNA, 48 bp, Artificial Sequence
  Description of Artificial Sequence: Synthetic primer
tctcagcagccagctcaggctgtcgccgttccaggacacggtcacggg

SEQ ID NO: 1089 - DNA, 51 bp, Artificial Sequence
  Description of Artificial Sequence: Synthetic primer
ctgagctggctgctgagactgctgaacggagccctgacctccggcgtgcac

SEQ ID NO: 1090 - DNA, 49 bp, Artificial Sequence
  Description of Artificial Sequence: Synthetic primer
tctcagcagccagctcaggctgtcgccgctgttccaggacacggtcacg

SEQ ID NO: 1091 - DNA, 45 bp, Artificial Sequence
  Description of Artificial Sequence: Synthetic primer
ctgagctggctgctgagactgctgaacgccctgacctccggcgtg

SEQ ID NO: 1092 - DNA, 47 bp, Artificial Sequence
  Description of Artificial Sequence: Synthetic primer
tctcagcagccagctcaggctgtcgcctccgctgttccaggacacgg

SEQ ID NO: 1093 - DNA, 47 bp, Artificial Sequence
  Description of Artificial Sequence: Synthetic primer
ctgagctggctgctgagactgctgaacctgacctccggcgtgcacac

SEQ ID NO: 1094 - DNA, 48 bp, Artificial Sequence
  Description of Artificial Sequence: Synthetic primer
tctcagcagccagctcaggctgtcgccggctccgctgttccaggacac

SEQ ID NO: 1095 - DNA, 48 bp, Artificial Sequence
  Description of Artificial Sequence: Synthetic primer
tctcagcagccagctcaggctgtcgccgatatcagcagtggcaccggg

SEQ ID NO: 1096 - DNA, 49 bp, Artificial Sequence
  Description of Artificial Sequence: Synthetic primer
tctcagcagccagctcaggctgtcgccgtactgctcctctctgggcttg

SEQ ID NO: 1097 - DNA, 49 bp, Artificial Sequence
  Description of Artificial Sequence: Synthetic primer
tctcagcagccagctcaggctgtcgccgttgtactgctcctctctgggc

SEQ ID NO: 1098 - DNA, 49 bp, Artificial Sequence
  Description of Artificial Sequence: Synthetic primer
cttgctggcgatgaactccaggctgtcgtactgctcctctctgggcttg

SEQ ID NO: 1099 - DNA, 49 bp, Artificial Sequence
  Description of Artificial Sequence: Synthetic primer
cttgctggcgatgaactccaggctgtcgttgtactgctcctctctgggc

SEQ ID NO: 1100 - DNA, 28 bp, Artificial Sequence
  Description of Artificial Sequence: Synthetic primer
cagccagctcagggcgtcgccctcgggc

SEQ ID NO: 1101 - DNA, 48 bp, Artificial Sequence
  Description of Artificial Sequence: Synthetic primer
acgggccctctagacttatgactttgtaccatttcgtattggaatttc

SEQ ID NO: 1102 - DNA, 38 bp, Artificial Sequence
  Description of Artificial Sequence: Synthetic primer
gtgatggtgatggtgatgaggctgagcagtggcaccgg

SEQ ID NO: 1103 - DNA, 48 bp, Artificial Sequence
  Description of Artificial Sequence: Synthetic primer
gtgatggtgatggtgatgtgactttgtaccatttcgtattggaatttc

SEQ ID NO: 1104 - DNA, 20 bp, Artificial Sequence
  Description of Artificial Sequence: Synthetic primer
aggctgagcagtggcaccgg

SEQ ID NO: 1105 - DNA, 24 bp, Artificial Sequence
  Description of Artificial Sequence: Synthetic primer
ttactctccgatgaggatgttacc

SEQ ID NO: 1106 - protein, 6 aa, Artificial Sequence
  Description of Artificial Sequence: Synthetic 6xHis tag
HHHHHH

SEQ ID NO: 1107 - protein, 340 aa, Artificial Sequence; identical to SEQ ID NO: 127
  Description of Artificial Sequence: Synthetic anti-hHER2-HC-E388-GDS-ppan-MC-ValCit-PABC-MMAF- LSWLLRLLN-N389 polypeptide
  MOD_RES (273)..(273): Ser at this position is modified with ppan-MC-ValCit-PABC-MMAF

SEQ ID NO: 1108 - protein, 340 aa, Artificial Sequence; identical to SEQ ID NO: 121
  Description of Artificial Sequence: Synthetic anti-hHER2-HC-T359-GDS-ppan-MC-ValCit-PABC-MMAF- LSWLLRLLN-K360 polypeptide
  MOD_RES (244)..(244): Ser at this position is modified with ppan-MC-ValCit-PABC-MMAF

SEQ ID NO: 1109 - protein, 328 aa, Artificial Sequence
  Description of Artificial Sequence: Synthetic polypeptide
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1110 - protein, 328 aa, Homo sapiens
STKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1111 - protein, 324 aa, Homo sapiens
STKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPG

SEQ ID NO: 1112 - protein, 375 aa, Homo sapiens
STKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPG

SEQ ID NO: 1113 - protein, 325 aa, Homo sapiens
STKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 1114 - protein, 106 aa, Artificial Sequence
  Description of Artificial Sequence: Synthetic polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1115 - protein, 106 aa, Homo sapiens; identical to SEQ ID NO: 1114

SEQ ID NO: 1116 - protein, 8 aa, Artificial Sequence
  Description of Artificial Sequence: Synthetic peptide
DSLEFIAS

SEQ ID NO: 1117 - protein, 340 aa, Artificial Sequence; identical to SEQ ID NO: 121
  Description of Artificial Sequence: Synthetic anti-hHER2-HC-T359-GDS-ppan-MC-MMAF-LSWLLRLLN-K360 polypeptide
  MOD_RES (244)..(244): Ser at this position is modified with ppan-MC-MMAF

SEQ ID NO: 1118 - protein, 340 aa, Artificial Sequence; identical to SEQ ID NO: 127
  Description of Artificial Sequence: Synthetic anti-hHER2-HC-E388-GDS-ppan-MC-MMAF-LSWLLRLLN-N389 polypeptide
  MOD_RES (273)..(273): Ser at this position is modified with ppan-MC-MMAF

SEQ ID NO: 1119 - protein, 460 aa, Artificial Sequence; identical to SEQ ID NO: 95
  Description of Artificial Sequence: Synthetic anti-hHER2-HC-V2-DS-ppan-MC-MMAF-LEFIASKLA-Q3 polypeptide
  MOD_RES (4)..(4): Ser at this position is modified with ppan-MC-MMAF

SEQ ID NO: 1120 - protein, 461 aa, Artificial Sequence; identical to SEQ ID NO: 94
  Description of Artificial Sequence: Synthetic anti-hHER2-HC-V2-GDS-ppan-MC-MMAF-LSWLLRLLN-Q3 polypeptide
  MOD_RES (5)..(5): Ser at this position is modified with ppan-MC-MMAF

SEQ ID NO: 1121 - protein, 338 aa, Artificial Sequence; identical to SEQ ID NO: 130
  Description of Artificial Sequence: Synthetic anti-hHER2-HC-E388-DS-ppan-MC-MMAF-LEFIASKL-N389 polypeptide
  MOD_RES (272)..(272): Ser at this position is modified with ppan-MC-MMAF

SEQ ID NO: 1122 - protein, 339 aa, Artificial Sequence; identical to SEQ ID NO: 129
  Description of Artificial Sequence: Synthetic anti-hHER2-HC-E388-DS-ppan-MC-MMAF-LEFIASKLA-N389 polypeptide
  MOD_RES (272)..(272): Ser at this position is modified with ppan-MC-MMAF

SEQ ID NO: 1123 - protein, 340 aa, Artificial Sequence; identical to SEQ ID NO: 148
  Description of Artificial Sequence: Synthetic mAb2-HC-T359-GDS-ppan-MC-MMAF-LSWLLRLLN-K360 polypeptide
  MOD_RES (244)..(244): Ser at this position is modified with ppan-MC-MMAF

SEQ ID NO: 1124 - protein, 225 aa, Artificial Sequence; identical to SEQ ID NO: 27
  Description of Artificial Sequence: Synthetic anti-hHER2-LC-I2-DS-ppan-MC-MMAF-LEFIASKLA-Q3 polypeptide
  MOD_RES (4)..(4): Ser at this position is modified with ppan-MC-MMAF

SEQ ID NO: 1125 - protein, 457 aa, Artificial Sequence; identical to SEQ ID NO: 99
  Description of Artificial Sequence: Synthetic anti-hHER2-HC-S63-ppan-MC-MMAF-V64L-EFIASKLA-K65 polypeptide
  MOD_RES (63)..(63): Ser at this position is modified with ppan-MC-MMAF

SEQ ID NO: 1126 - protein, 222 aa, Artificial Sequence; identical to SEQ ID NO: 30
  Description of Artificial Sequence: Synthetic anti-hHER2-LC-S76D-S77-ppan-MC-MMAF-L78-EFIASKLA-Q79 polypeptide
  MOD_RES (77)..(77): Ser at this position is modified with ppan-MC-MMAF

SEQ ID NO: 1127 - protein, 328 aa, Artificial Sequence; identical to SEQ ID NO: 109
  Description of Artificial Sequence: Synthetic anti-hHER2-HC-P189G-S190D-S191-ppan-maleimidoethylamido- TMR-S192L-L193S-G194W-T195L polypeptide
  MOD_RES (73)..(73): Ser at this position is modified with ppan-maleimidoethylamido-TMR

SEQ ID NO: 1128 - protein, 340 aa, Artificial Sequence; identical to SEQ ID NO: 121
  Description of Artificial Sequence: Synthetic anti-hHER2-HC-T359-GDS-ppan-maleimidoethylamido-TMR- LSWLLRLLN-K360 polypeptide
  MOD_RES (244)..(244): Ser at this position is modified with ppan-maleimidoethylamido-TMR

SEQ ID NO: 1129 - protein, 340 aa, Artificial Sequence; identical to SEQ ID NO: 127
  Description of Artificial Sequence: Synthetic anti-hHER2-HC-E388-GDS-MC-MMAF-LSWLLRLLN-N389 polypeptide
  MOD_RES (273)..(273): Ser at this position is modified with MC-MMAF

SEQ ID NO: 1130 - protein, 106 aa, Artificial Sequence; identical to SEQ ID NO: 1114
  Description of Artificial Sequence: Synthetic polypeptide

SEQ ID NO: 1131 - protein, 328 aa, Artificial Sequence; identical to SEQ ID NO: 1110
  Description of Artificial Sequence: Synthetic polypeptide

SEQ ID NO: 1132 - protein, 68 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRF

SEQ ID NO: 1133 - protein, 72 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISA

SEQ ID NO: 1134 - protein, 77 aa, Artificial Sequence
  Description of Artificial Sequence: Synthetic polypeptide
NSLRAEDTAVYYCSRWGGDGFYAMDYWGQGTLVTVSSASTKGPSVFPLAPSSKSTSGGTAALGCLVKDYFPEPVTVS

SEQ ID NO: 1135 - protein, 77 aa, Artificial Sequence
  Description of Artificial Sequence: Synthetic polypeptide
NSLRAEDTAVYYCSRWGGDGFYAMDYWGQGTLVTVSSASTKGPSVFPLAPSGDSLSWLTAALGCLVKDYFPEPVTVS

SEQ ID NO: 1136 - protein, 340 aa, Artificial Sequence; identical to SEQ ID NO: 150
  Description of Artificial Sequence: Synthetic anti-hHER2-HC-A118-GDS-ppan-MC-MMAF-LSWLLRLLN-S119 polypeptide
  MOD_RES (3)..(3): Ser at this position is modified with ppan-MC-MMAF

SEQ ID NO: 1137 - protein, 340 aa, Artificial Sequence; identical to SEQ ID NO: 151
  Description of Artificial Sequence: Synthetic anti-hHER2-HC-S119-GDS-ppan-MC-MMAF-LSWLLRLLN-T120 polypeptide
  MOD_RES (4)..(4): Ser at this position is modified with ppan-MC-MMAF

SEQ ID NO: 1138 - protein, 340 aa, Artificial Sequence; identical to SEQ ID NO: 152
  Description of Artificial Sequence: Synthetic anti-hHER2-HC-T120-GDS-ppan-MC-MMAF-LSWLLRLLN-K121 polypeptide
  MOD_RES (5)..(5): Ser at this position is modified with ppan-MC-MMAF

SEQ ID NO: 1139 - protein, 340 aa, Artificial Sequence; identical to SEQ ID NO: 157
  Description of Artificial Sequence: Synthetic anti-hHER2-HC-T135-GDS-ppan-MC-MMAF-LSWLLRLLN-S136 polypeptide
  MOD_RES (20)..(20): Ser at this position is modified with ppan-MC-MMAF

SEQ ID NO: 1140 - protein, 340 aa, Artificial Sequence; identical to SEQ ID NO: 158
  Description of Artificial Sequence: Synthetic anti-hHER2-HC-S136-GDS-ppan-MC-MMAF-LSWLLRLLN-G137 polypeptide
  MOD_RES (21)..(21): Ser at this position is modified with ppan-MC-MMAF

SEQ ID NO: 1141 - protein, 340 aa, Artificial Sequence; identical to SEQ ID NO: 160
  Description of Artificial Sequence: Synthetic anti-hHER2-HC-G138-GDS-ppan-MC-MMAF-LSWLLRLLN-T139 polypeptide
  MOD_RES (23)..(23): Ser at this position is modified with ppan-MC-MMAF

SEQ ID NO: 1142 - protein, 340 aa, Artificial Sequence; identical to SEQ ID NO: 161
  Description of Artificial Sequence: Synthetic anti-hHER2-HC-E152-GDS-ppan-MC-MMAF-LSWLLRLLN-P153 polypeptide
  MOD_RES (37)..(37): Ser at this position is modified with ppan-MC-MMAF

SEQ ID NO: 1143 - protein, 340 aa, Artificial Sequence; identical to SEQ ID NO: 162
  Description of Artificial Sequence: Synthetic anti-hHER2-HC-P153-GDS-ppan-MC-MMAF-LSWLLRLLN-V154 polypeptide
  MOD_RES (38)..(38): Ser at this position is modified with ppan-MC-MMAF

SEQ ID NO: 1144 - protein, 340 aa, Artificial Sequence; identical to SEQ ID NO: 163
  Description of Artificial Sequence: Synthetic anti-hHER2-HC-N159-GDS-ppan-MC-MMAF-LSWLLRLLN-S160 polypeptide
  MOD_RES (44)..(44): Ser at this position is modified with ppan-MC-MMAF

SEQ ID NO: 1145 - protein, 340 aa, Artificial Sequence; identical to SEQ ID NO: 164
  Description of Artificial Sequence: Synthetic anti-hHER2-HC-S160-GDS-ppan-MC-MMAF-LSWLLRLLN-G161 polypeptide
  MOD_RES (45)..(45): Ser at this position is modified with ppan-MC-MMAF

SEQ ID NO: 1146 - protein, 340 aa, Artificial Sequence; identical to SEQ ID NO: 165
  Description of Artificial Sequence: Synthetic anti-hHER2-HC-G161-GDS-ppan-MC-MMAF-LSWLLRLLN-A162 polypeptide
  MOD_RES (46)..(46): Ser at this position is modified with ppan-MC-MMAF

SEQ ID NO: 1147 - protein, 340 aa, Artificial Sequence; identical to SEQ ID NO: 166
  Description of Artificial Sequence: Synthetic anti-hHER2-HC-A162-GDS-ppan-MC-MMAF-LSWLLRLLN-L163 polypeptide
  MOD_RES (47)..(47): Ser at this position is modified with ppan-MC-MMAF

SEQ ID NO: 1148 - protein, 340 aa, Artificial Sequence; identical to SEQ ID NO: 168
  Description of Artificial Sequence: Synthetic anti-hHER2-HC-T164-GDS-ppan-MC-MMAF-LSWLLRLLN-S165 polypeptide
  MOD_RES (49)..(49): Ser at this position is modified with ppan-MC-MMAF

SEQ ID NO: 1149 - protein, 340 aa, Artificial Sequence; identical to SEQ ID NO: 169
  Description of Artificial Sequence: Synthetic anti-hHER2-HC-S165-GDS-ppan-MC-MMAF-LSWLLRLLN-G166 polypeptide
  MOD_RES (50)..(50): Ser at this position is modified with ppan-MC-MMAF

SEQ ID NO: 1150 - protein, 340 aa, Artificial Sequence; identical to SEQ ID NO: 170
  Description of Artificial Sequence: Synthetic anti-hHER2-HC-P171-GDS-ppan-MC-MMAF-LSWLLRLLN-A172 polypeptide
  MOD_RES (56)..(56): Ser at this position is modified with ppan-MC-MMAF

SEQ ID NO: 1151 - protein, 340 aa, Artificial Sequence; identical to SEQ ID NO: 171
  Description of Artificial Sequence: Synthetic anti-hHER2-HC-S176-GDS-ppan-MC-MMAF-LSWLLRLLN-S177 polypeptide
  MOD_RES (61)..(61): Ser at this position is modified with ppan-MC-MMAF

SEQ ID NO: 1152 - protein, 340 aa, Artificial Sequence; identical to SEQ ID NO: 173
  Description of Artificial Sequence: Synthetic anti-hHER2-HC-P189-GDS-ppan-MC-MMAF-LSWLLRLLN-S190 polypeptide
  MOD_RES (74)..(74): Ser at this position is modified with ppan-MC-MMAF

SEQ ID NO: 1153 - protein, 340 aa, Artificial Sequence; identical to SEQ ID NO: 175
  Description of Artificial Sequence: Synthetic anti-hHER2-HC-S191-GDS-ppan-MC-MMAF-LSWLLRLLN-S192 polypeptide
  MOD_RES (76)..(76): Ser at this position is modified with ppan-MC-MMAF

SEQ ID NO: 1154 - protein, 340 aa, Artificial Sequence; identical to SEQ ID NO: 176
  Description of Artificial Sequence: Synthetic anti-hHER2-HC-S192-GDS-ppan-MC-MMAF-LSWLLRLLN-L193 polypeptide
  MOD_RES (77)..(77): Ser at this position is modified with ppan-MC-MMAF

SEQ ID NO: 1155 - protein, 340 aa, Artificial Sequence; identical to SEQ ID NO: 177
  Description of Artificial Sequence: Synthetic anti-hHER2-HC-L193-GDS-ppan-MC-MMAF-LSWLLRLLN-G194 polypeptide
  MOD_RES (78)..(78): Ser at this position is modified with ppan-MC-MMAF

SEQ ID NO: 1156 - protein, 340 aa, Artificial Sequence; identical to SEQ ID NO: 178
  Description of Artificial Sequence: Synthetic anti-hHER2-HC-G194-GDS-ppan-MC-MMAF-LSWLLRLLN-T195 polypeptide
  MOD_RES (79)..(79): Ser at this position is modified with ppan-MC-MMAF

SEQ ID NO: 1157 - protein, 340 aa, Artificial Sequence; identical to SEQ ID NO: 179
  Description of Artificial Sequence: Synthetic anti-hHER2-HC-T195-GDS-ppan-MC-MMAF-LSWLLRLLN-Q196 polypeptide
  MOD_RES (80)..(80): Ser at this position is modified with ppan-MC-MMAF

SEQ ID NO: 1158 - protein, 340 aa, Artificial Sequence; identical to SEQ ID NO: 180
  Description of Artificial Sequence: Synthetic anti-hHER2-HC-Q196-GDS-ppan-MC-MMAF-LSWLLRLLN-T197 polypeptide
  MOD_RES (81)..(81): Ser at this position is modified with ppan-MC-MMAF

SEQ ID NO: 1159 - protein, 340 aa, Artificial Sequence; identical to SEQ ID NO: 181
  Description of Artificial Sequence: Synthetic anti-hHER2-HC-K205-GDS-ppan-MC-MMAF-LSWLLRLLN-P206 polypeptide
  MOD_RES (90)..(90): Ser at this position is modified with ppan-MC-MMAF

SEQ ID NO: 1160 - protein, 340 aa, Artificial Sequence; identical to SEQ ID NO: 182
  Description of Artificial Sequence: Synthetic anti-hHER2-HC-P206-GDS-ppan-MC-MMAF-LSWLLRLLN-S207 polypeptide
  MOD_RES (91)..(91): Ser at this position is modified with ppan-MC-MMAF

SEQ ID NO: 1161 - protein, 340 aa, Artificial Sequence; identical to SEQ ID NO: 185
  Description of Artificial Sequence: Synthetic anti-hHER2-HC-A231-GDS-ppan-MC-MMAF-LSWLLRLLN-P232 polypeptide
  MOD_RES (116)..(116): Ser at this position is modified with ppan-MC-MMAF

SEQ ID NO: 1162 - protein, 340 aa, Artificial Sequence; identical to SEQ ID NO: 187
  Description of Artificial Sequence: Synthetic anti-hHER2-HC-E233-GDS-ppan-MC-MMAF-LSWLLRLLN-L234 polypeptide
  MOD_RES (118)..(118): Ser at this position is modified with ppan-MC-MMAF

SEQ ID NO: 1163 - protein, 340 aa, Artificial Sequence; identical to SEQ ID NO: 189
  Description of Artificial Sequence: Synthetic anti-hHER2-HC-L235-GDS-ppan-MC-MMAF-LSWLLRLLN-G236 polypeptide
  MOD_RES (120)..(120): Ser at this position is modified with ppan-MC-MMAF

SEQ ID NO: 1164 - protein, 340 aa, Artificial Sequence; identical to SEQ ID NO: 191
  Description of Artificial Sequence: Synthetic anti-hHER2-HC-P244-GDS-ppan-MC-MMAF-LSWLLRLLN-P245 polypeptide
  MOD_RES (129)..(129): Ser at this position is modified with ppan-MC-MMAF

SEQ ID NO: 1165 - protein, 340 aa, Artificial Sequence; identical to SEQ ID NO: 193
  Description of Artificial Sequence: Synthetic anti-hHER2-HC-I253-GDS-ppan-MC-MMAF-LSWLLRLLN-S254 polypeptide
  MOD_RES (138)..(138): Ser at this position is modified with ppan-MC-MMAF

SEQ ID NO: 1166 - protein, 340 aa, Artificial Sequence; identical to SEQ ID NO: 194
  Description of Artificial Sequence: Synthetic anti-hHER2-HC-S254-GDS-ppan-MC-MMAF-LSWLLRLLN-R255 polypeptide
  MOD_RES (139)..(139): Ser at this position is modified with ppan-MC-MMAF

SEQ ID NO: 1167 - protein, 340 aa, Artificial Sequence; identical to SEQ ID NO: 195
  Description of Artificial Sequence: Synthetic anti-hHER2-HC-R255-GDS-ppan-MC-MMAF-LSWLLRLLN-T256 polypeptide
  MOD_RES (140)..(140): Ser at this position is modified with ppan-MC-MMAF

SEQ ID NO: 1168 - protein, 340 aa, Artificial Sequence; identical to SEQ ID NO: 198
  Description of Artificial Sequence: Synthetic anti-hHER2-HC-S267-GDS-ppan-MC-MMAF-LSWLLRLLN-H268 polypeptide
  MOD_RES (152)..(152): Ser at this position is modified with ppan-MC-MMAF

SEQ ID NO: 1169 - protein, 340 aa, Artificial Sequence; identical to SEQ ID NO: 199
  Description of Artificial Sequence: Synthetic anti-hHER2-HC-H268-GDS-ppan-MC-MMAF-LSWLLRLLN-E269 polypeptide
  MOD_RES (153)..(153): Ser at this position is modified with ppan-MC-MMAF

SEQ ID NO: 1170 - protein, 340 aa, Artificial Sequence; identical to SEQ ID NO: 200
  Description of Artificial Sequence: Synthetic anti-hHER2-HC-E269-GDS-ppan-MC-MMAF-LSWLLRLLN-D270 polypeptide
  MOD_RES (154)..(154): Ser at this position is modified with ppan-MC-MMAF

SEQ ID NO: 1171 - protein, 340 aa, Artificial Sequence; identical to SEQ ID NO: 201
  Description of Artificial Sequence: Synthetic anti-hHER2-HC-D270-GDS-ppan-MC-MMAF-LSWLLRLLN-P271 polypeptide
  MOD_RES (155)..(155): Ser at this position is modified with ppan-MC-MMAF

SEQ ID NO: 1172 - protein, 340 aa, Artificial Sequence; identical to SEQ ID NO: 202
  Description of Artificial Sequence: Synthetic anti-hHER2-HC-P271-GDS-ppan-MC-MMAF-LSWLLRLLN-E272 polypeptide
  MOD_RES (156)..(156): Ser at this position is modified with ppan-MC-MMAF

SEQ ID NO: 1173 - protein, 340 aa, Artificial Sequence; identical to SEQ ID NO: 206
  Description of Artificial Sequence: Synthetic anti-hHER2-HC-P291-GDS-ppan-MC-MMAF-LSWLLRLLN-R292 polypeptide
  MOD_RES (176)..(176): Ser at this position is modified with ppan-MC-MMAF

SEQ ID NO: 1174 - protein, 340 aa, Artificial Sequence; identical to SEQ ID NO: 207
  Description of Artificial Sequence: Synthetic anti-hHER2-HC-T307-GDS-ppan-MC-MMAF-LSWLLRLLN-V308 polypeptide
  MOD_RES (192)..(192): Ser at this position is modified with ppan-MC-MMAF

SEQ ID NO: 1175 - protein, 340 aa, Artificial Sequence; identical to SEQ ID NO: 209
  Description of Artificial Sequence: Synthetic anti-hHER2-HC-L309-GDS-ppan-MC-MMAF-LSWLLRLLN-H310 polypeptide
  MOD_RES (194)..(194): Ser at this position is modified with ppan-MC-MMAF

SEQ ID NO: 1176 - protein, 340 aa, Artificial Sequence; identical to SEQ ID NO: 211
  Description of Artificial Sequence: Synthetic anti-hHER2-HC-N315-GDS-ppan-MC-MMAF-LSWLLRLLN-G316 polypeptide
  MOD_RES (200)..(200): Ser at this position is modified with ppan-MC-MMAF

SEQ ID NO: 1177 - protein, 340 aa, Artificial Sequence; identical to SEQ ID NO: 212
  Description of Artificial Sequence: Synthetic anti-hHER2-HC-G316-GDS-ppan-MC-MMAF-LSWLLRLLN-K317 polypeptide
  MOD_RES (201)..(201): Ser at this position is modified with ppan-MC-MMAF

SEQ ID NO: 1178 - protein, 340 aa, Artificial Sequence; identical to SEQ ID NO: 215
  Description of Artificial Sequence: Synthetic anti-hHER2-HC-A327-GDS-ppan-MC-MMAF-LSWLLRLLN-L328 polypeptide
  MOD_RES (212)..(212): Ser at this position is modified with ppan-MC-MMAF

SEQ ID NO: 1179 - protein, 340 aa, Artificial Sequence; identical to SEQ ID NO: 216
  Description of Artificial Sequence: Synthetic anti-hHER2-HC-L328-GDS-ppan-MC-MMAF-LSWLLRLLN-P329 polypeptide
  MOD_RES (213)..(213): Ser at this position is modified with ppan-MC-MMAF

SEQ ID NO: 1180 - protein, 340 aa, Artificial Sequence; identical to SEQ ID NO: 217
  Description of Artificial Sequence: Synthetic anti-hHER2-HC-P329-GDS-ppan-MC-MMAF-LSWLLRLLN-A330 polypeptide
  MOD_RES (214)..(214): Ser at this position is modified with ppan-MC-MMAF

SEQ ID NO: 1181 - protein, 340 aa, Artificial Sequence; identical to SEQ ID NO: 218
  Description of Artificial Sequence: Synthetic anti-hHER2-HC-A330-GDS-ppan-MC-MMAF-LSWLLRLLN-P331 polypeptide
  MOD_RES (215)..(215): Ser at this position is modified with ppan-MC-MMAF

SEQ ID NO: 1182 - protein, 340 aa, Artificial Sequence; identical to SEQ ID NO: 220
  Description of Artificial Sequence: Synthetic anti-hHER2-HC-K340-GDS-ppan-MC-MMAF-LSWLLRLLN-G341 polypeptide
  MOD_RES (225)..(225): Ser at this position is modified with ppan-MC-MMAF

SEQ ID NO: 1183 - protein, 340 aa, Artificial Sequence; identical to SEQ ID NO: 221
  Description of Artificial Sequence: Synthetic anti-hHER2-HC-G341-GDS-ppan-MC-MMAF-LSWLLRLLN-Q342 polypeptide
  MOD_RES (226)..(226): Ser at this position is modified with ppan-MC-MMAF

SEQ ID NO: 1184 - protein, 340 aa, Artificial Sequence; identical to SEQ ID NO: 222
  Description of Artificial Sequence: Synthetic anti-hHER2-HC-Q342-GDS-ppan-MC-MMAF-LSWLLRLLN-P343 polypeptide
  MOD_RES (227)..(227): Ser at this position is modified with ppan-MC-MMAF

SEQ ID NO: 1185 - protein, 340 aa, Artificial Sequence; identical to SEQ ID NO: 223
  Description of Artificial Sequence: Synthetic anti-hHER2-HC-P343-GDS-ppan-MC-MMAF-LSWLLRLLN-R344 polypeptide
  MOD_RES (228)..(228): Ser at this position is modified with ppan-MC-MMAF

SEQ ID NO: 1186 - protein, 340 aa, Artificial Sequence; identical to SEQ ID NO: 224
  Description of Artificial Sequence: Synthetic anti-hHER2-HC-R344-GDS-ppan-MC-MMAF-LSWLLRLLN-E345 polypeptide
  MOD_RES (229)..(229): Ser at this position is modified with ppan-MC-MMAF

SEQ ID NO: 1187 - protein, 340 aa, Artificial Sequence; identical to SEQ ID NO: 229
  Description of Artificial Sequence: Synthetic anti-hHER2-HC-K360-GDS-ppan-MC-MMAF-LSWLLRLLN-N361 polypeptide
  MOD_RES (245)..(245): Ser at this position is modified with ppan-MC-MMAF

SEQ ID NO: 1188 - protein, 340 aa, Artificial Sequence; identical to SEQ ID NO: 230
  Description of Artificial Sequence: Synthetic anti-hHER2-HC-N384-GDS-ppan-MC-MMAF-LSWLLRLLN-G385 polypeptide
  MOD_RES (269)..(269): Ser at this position is modified with ppan-MC-MMAF

SEQ ID NO: 1189 - protein, 340 aa, Artificial Sequence; identical to SEQ ID NO: 232
  Description of Artificial Sequence: Synthetic anti-hHER2-HC-T394-GDS-ppan-MC-MMAF-LSWLLRLLN-P395 polypeptide
  MOD_RES (279)..(279): Ser at this position is modified with ppan-MC-MMAF

SEQ ID NO: 1190 - protein, 340 aa, Artificial Sequence; identical to SEQ ID NO: 233
  Description of Artificial Sequence: Synthetic anti-hHER2-HC-P395-GDS-ppan-MC-MMAF-LSWLLRLLN-P396 polypeptide
  MOD_RES (280)..(280): Ser at this position is modified with ppan-MC-MMAF

SEQ ID NO: 1191 - protein, 340 aa, Artificial Sequence; identical to SEQ ID NO: 235
  Description of Artificial Sequence: Synthetic anti-hHER2-HC-D401-GDS-ppan-MC-MMAF-LSWLLRLLN-G402 polypeptide
  MOD_RES (286)..(286): Ser at this position is modified with ppan-MC-MMAF

SEQ ID NO: 1192 - protein, 340 aa, Artificial Sequence; identical to SEQ ID NO: 236
  Description of Artificial Sequence: Synthetic anti-hHER2-HC-S415-GDS-ppan-MC-MMAF-LSWLLRLLN-R416 polypeptide
  MOD_RES (300)..(300): Ser at this position is modified with ppan-MC-MMAF

SEQ ID NO: 1193 - protein, 340 aa, Artificial Sequence; identical to SEQ ID NO: 237
  Description of Artificial Sequence: Synthetic anti-hHER2-HC-R416-GDS-ppan-MC-MMAF-LSWLLRLLN-W417 polypeptide
  MOD_RES (301)..(301): Ser at this position is modified with ppan-MC-MMAF

SEQ ID NO: 1194 - protein, 340 aa, Artificial Sequence; identical to SEQ ID NO: 238
  Description of Artificial Sequence: Synthetic anti-hHER2-HC-W417-GDS-ppan-MC-MMAF-LSWLLRLLN-Q418 polypeptide
  MOD_RES (302)..(302): Ser at this position is modified with ppan-MC-MMAF

SEQ ID NO: 1195 - protein, 340 aa, Artificial Sequence; identical to SEQ ID NO: 239
  Description of Artificial Sequence: Synthetic anti-hHER2-HC-Q418-GDS-ppan-MC-MMAF-LSWLLRLLN-Q419 polypeptide
  MOD_RES (303)..(303): Ser at this position is modified with ppan-MC-MMAF

SEQ ID NO: 1196 - protein, 340 aa, Artificial Sequence; identical to SEQ ID NO: 243
  Description of Artificial Sequence: Synthetic anti-hHER2-HC-H433-GDS-ppan-MC-MMAF-LSWLLRLLN-N434 polypeptide
  MOD_RES (318)..(318): Ser at this position is modified with ppan-MC-MMAF

SEQ ID NO: 1197 - protein, 340 aa, Artificial Sequence; identical to SEQ ID NO: 244
  Description of Artificial Sequence: Synthetic anti-hHER2-HC-N434-GDS-ppan-MC-MMAF-LSWLLRLLN-H435 polypeptide
  MOD_RES (319)..(319): Ser at this position is modified with ppan-MC-MMAF

SEQ ID NO: 1198 - protein, 340 aa, Artificial Sequence; identical to SEQ ID NO: 246
  Description of Artificial Sequence: Synthetic anti-hHER2-HC-L443-GDS-ppan-MC-MMAF-LSWLLRLLN-S444 polypeptide
  MOD_RES (328)..(328): Ser at this position is modified with ppan-MC-MMAF

SEQ ID NO: 1199 - protein, 340 aa, Artificial Sequence; identical to SEQ ID NO: 248
  Description of Artificial Sequence: Synthetic anti-hHER2-HC-P445-GDS-ppan-MC-MMAF-LSWLLRLLN-G446 polypeptide
  MOD_RES (330)..(330): Ser at this position is modified with ppan-MC-MMAF

SEQ ID NO: 1200 - protein, 339 aa, Artificial Sequence; identical to SEQ ID NO: 249
  Description of Artificial Sequence: Synthetic anti-hHER2-HC-A118-DS-ppan-MC-MMAF-LEFIASKLA-S119 polypeptide
  MOD_RES (2)..(2): Ser at this position is modified with ppan-MC-MMAF

SEQ ID NO: 1201 - protein, 339 aa, Artificial Sequence; identical to SEQ ID NO: 250
  Description of Artificial Sequence: Synthetic anti-hHER2-HC-S119-DS-ppan-MC-MMAF-LEFIASKLA-T120 polypeptide
  MOD_RES (3)..(3): Ser at this position is modified with ppan-MC-MMAF

SEQ ID NO: 1202 - protein, 339 aa, Artificial Sequence; identical to SEQ ID NO: 251
  Description of Artificial Sequence: Synthetic anti-hHER2-HC-T120-DS-ppan-MC-MMAF-LEFIASKLA-K121 polypeptide
  MOD_RES (4)..(4): Ser at this position is modified with ppan-MC-MMAF

SEQ ID NO: 1203 - protein, 339 aa, Artificial Sequence; identical to SEQ ID NO: 257
  Description of Artificial Sequence: Synthetic anti-hHER2-HC-S136-DS-ppan-MC-MMAF-LEFIASKLA-137 polypeptide
  MOD_RES (20)..(20): Ser at this position is modified with ppan-MC-MMAF

SEQ ID NO: 1204 - protein, 339 aa, Artificial Sequence; identical to SEQ ID NO: 259
  Description of Artificial Sequence: Synthetic anti-hHER2-HC-G138-DS-ppan-MC-MMAF-LEFIASKLA-T139 polypeptide
  MOD_RES (22)..(22): Ser at this position is modified with ppan-MC-MMAF

SEQ ID NO: 1205 - protein, 339 aa, Artificial Sequence; identical to SEQ ID NO: 261
  Description of Artificial Sequence: Synthetic anti-hHER2-HC-P153-DS-ppan-MC-MMAF-LEFIASKLA-V154 polypeptide
  MOD_RES (37)..(37): Ser at this position is modified with ppan-MC-MMAF

SEQ ID NO: 1206 - protein, 339 aa, Artificial Sequence; identical to SEQ ID NO: 262
  Description of Artificial Sequence: Synthetic anti-hHER2-HC-N159-DS-ppan-MC-MMAF-LEFIASKLA-S160 polypeptide
  MOD_RES (43)..(43): Ser at this position is modified with ppan-MC-MMAF

SEQ ID NO: 1207 - protein, 339 aa, Artificial Sequence; identical to SEQ ID NO: 265
  Description of Artificial Sequence: Synthetic anti-hHER2-HC-A162-DS-ppan-MC-MMAF-LEFIASKLA-L163 polypeptide
  MOD_RES (46)..(46): Ser at this position is modified with ppan-MC-MMAF

SEQ ID NO: 1208 - protein, 339 aa, Artificial Sequence; identical to SEQ ID NO: 267
  Description of Artificial Sequence: Synthetic anti-hHER2-HC-T164-DS-ppan-MC-MMAF-LEFIASKLA-S165 polypeptide
  MOD_RES (48)..(48): Ser at this position is modified with ppan-MC-MMAF

SEQ ID NO: 1209 - protein, 339 aa, Artificial Sequence; identical to SEQ ID NO: 268
  Description of Artificial Sequence: Synthetic anti-hHER2-HC-S165-DS-ppan-MC-MMAF-LEFIASKLA-G166 polypeptide
  MOD_RES (49)..(49): Ser at this position is modified with ppan-MC-MMAF

SEQ ID NO: 1210 - protein, 339 aa, Artificial Sequence; identical to SEQ ID NO: 269
  Description of Artificial Sequence: Synthetic anti-hHER2-HC-P171-DS-ppan-MC-MMAF-LEFIASKLA-A172 polypeptide
  MOD_RES (55)..(55): Ser at this position is modified with ppan-MC-MMAF

SEQ ID NO: 1211 - protein, 339 aa, Artificial Sequence; identical to SEQ ID NO: 270
  Description of Artificial Sequence: Synthetic anti-hHER2-HC-S176-DS-ppan-MC-MMAF-LEFIASKLA-S177 polypeptide
  MOD_RES (60)..(60): Ser at this position is modified with ppan-MC-MMAF

SEQ ID NO: 1212 - protein, 339 aa, Artificial Sequence; identical to SEQ ID NO: 273
  Description of Artificial Sequence: Synthetic anti-hHER2-HC-S190-DS-ppan-MC-MMAF-LEFIASKLA-S191 polypeptide
  MOD_RES (74)..(74): Ser at this position is modified with ppan-MC-MMAF

SEQ ID NO: 1213 - protein, 339 aa, Artificial Sequence; identical to SEQ ID NO: 274
  Description of Artificial Sequence: Synthetic anti-hHER2-HC-S191-DS-ppan-MC-MMAF-LEFIASKLA-S192 polypeptide
  MOD_RES (75)..(75): Ser at this position is modified with ppan-MC-MMAF

SEQ ID NO: 1214 - protein, 339 aa, Artificial Sequence; identical to SEQ ID NO: 275
  Description of Artificial Sequence: Synthetic anti-hHER2-HC-S192-DS-ppan-MC-MMAF-LEFIASKLA-L193 polypeptide
  MOD_RES (76)..(76): Ser at this position is modified with ppan-MC-MMAF

SEQ ID NO: 1215 - protein, 339 aa, Artificial Sequence; identical to SEQ ID NO: 277
  Description of Artificial Sequence: Synthetic anti-hHER2-HC-G194-DS-ppan-MC-MMAF-LEFIASKLA-T195 polypeptide
  MOD_RES (78)..(78): Ser at this position is modified with ppan-MC-MMAF

SEQ ID NO: 1216 - protein, 339 aa, Artificial Sequence; identical to SEQ ID NO: 278
  Description of Artificial Sequence: Synthetic anti-hHER2-HC-T195-DS-ppan-MC-MMAF-LEFIASKLA-Q196 polypeptide
  MOD_RES (79)..(79): Ser at this position is modified with ppan-MC-MMAF

SEQ ID NO: 1217 - protein, 339 aa, Artificial Sequence; identical to SEQ ID NO: 279
  Description of Artificial Sequence: Synthetic anti-hHER2-HC-Q196-DS-ppan-MC-MMAF-LEFIASKLA-T197 polypeptide
  MOD_RES (80)..(80): Ser at this position is modified with ppan-MC-MMAF

SEQ ID NO: 1218 - protein, 339 aa, Artificial Sequence; identical to SEQ ID NO: 280
  Description of Artificial Sequence: Synthetic anti-hHER2-HC-K205-DS-ppan-MC-MMAF-LEFIASKLA-P206 polypeptide
  MOD_RES (89)..(89): Ser at this position is modified with ppan-MC-MMAF

SEQ ID NO: 1219 - protein, 339 aa, Artificial Sequence; identical to SEQ ID NO: 281
  Description of Artificial Sequence: Synthetic anti-hHER2-HC-P206-DS-ppan-MC-MMAF-LEFIASKLA-S207 polypeptide
  MOD_RES (90)..(90): Ser at this position is modified with ppan-MC-MMAF

SEQ ID NO: 1220 - protein, 339 aa, Artificial Sequence; identical to SEQ ID NO: 286
  Description of Artificial Sequence: Synthetic anti-hHER2-HC-E233-DS-ppan-MC-MMAF-LEFIASKLA-L234 polypeptide
  MOD_RES (117)..(117): Ser at this position is modified with ppan-MC-MMAF

SEQ ID NO: 1221 - protein, 339 aa, Artificial Sequence; identical to SEQ ID NO: 288
  Description of Artificial Sequence: Synthetic anti-hHER2-HC-L235-DS-ppan-MC-MMAF-LEFIASKLA-G236 polypeptide
  MOD_RES (119)..(119): Ser at this position is modified with ppan-MC-MMAF

SEQ ID NO: 1222 - protein, 339 aa, Artificial Sequence; identical to SEQ ID NO: 289
  Description of Artificial Sequence: Synthetic anti-hHER2-HC-G236-DS-ppan-MC-MMAF-LEFIASKLA-G237 polypeptide
  MOD_RES (120)..(120): Ser at this position is modified with ppan-MC-MMAF

SEQ ID NO: 1223 - protein, 339 aa, Artificial Sequence; identical to SEQ ID NO: 290
  Description of Artificial Sequence: Synthetic anti-hHER2-HC-P244-DS-ppan-MC-MMAF-LEFIASKLA-P245 polypeptide
  MOD_RES (128)..(128): Ser at this position is modified with ppan-MC-MMAF

SEQ ID NO: 1224 - protein, 339 aa, Artificial Sequence; identical to SEQ ID NO: 291
  Description of Artificial Sequence: Synthetic anti-hHER2-HC-P245-DS-ppan-MC-MMAF-LEFIASKLA-K246 polypeptide
  MOD_RES (129)..(129): Ser at this position is modified with ppan-MC-MMAF

SEQ ID NO: 1225 - protein, 339 aa, Artificial Sequence; identical to SEQ ID NO: 292
  Description of Artificial Sequence: Synthetic anti-hHER2-HC-I253-DS-ppan-MC-MMAF-LEFIASKLA-S254 polypeptide
  MOD_RES (137)..(137): Ser at this position is modified with ppan-MC-MMAF

SEQ ID NO: 1226 - protein, 339 aa, Artificial Sequence; identical to SEQ ID NO: 293
  Description of Artificial Sequence: Synthetic anti-hHER2-HC-S254-DS-ppan-MC-MMAF-LEFIASKLA-R255 polypeptide
  MOD_RES (138)..(138): Ser at this position is modified with ppan-MC-MMAF

SEQ ID NO: 1227 - protein, 339 aa, Artificial Sequence; identical to SEQ ID NO: 294
  Description of Artificial Sequence: Synthetic anti-hHER2-HC-R255-DS-ppan-MC-MMAF-LEFIASKLA-T256 polypeptide
  MOD_RES (139)..(139): Ser at this position is modified with ppan-MC-MMAF

SEQ ID NO: 1228 - protein, 339 aa, Artificial Sequence; identical to SEQ ID NO: 296
  Description of Artificial Sequence: Synthetic anti-hHER2-HC-P257-DS-ppan-MC-MMAF-LEFIASKLA-E258 polypeptide
  MOD_RES (141)..(141): Ser at this position is modified with ppan-MC-MMAF

SEQ ID NO: 1229 - protein, 339 aa, Artificial Sequence; identical to SEQ ID NO: 297
  Description of Artificial Sequence: Synthetic anti-hHER2-HC-S267-DS-ppan-MC-MMAF-LEFIASKLA-H268 polypeptide
  MOD_RES (151)..(151): Ser at this position is modified with ppan-MC-MMAF

SEQ ID NO: 1230 - protein, 339 aa, Artificial Sequence; identical to SEQ ID NO: 298
  Description of Artificial Sequence: Synthetic anti-hHER2-HC-H268-DS-ppan-MC-MMAF-LEFIASKLA-E269 polypeptide
  MOD_RES (152)..(152): Ser at this position is modified with ppan-MC-MMAF

SEQ ID NO: 1231 - protein, 339 aa, Artificial Sequence; identical to SEQ ID NO: 299
  Description of Artificial Sequence: Synthetic anti-hHER2-HC-E269-DS-ppan-MC-MMAF-LEFIASKLA-D270 polypeptide
  MOD_RES (153)..(153): Ser at this position is modified with ppan-MC-MMAF

SEQ ID NO: 1232 - protein, 339 aa, Artificial Sequence; identical to SEQ ID NO: 300
  Description of Artificial Sequence: Synthetic anti-hHER2-HC-D270-DS-ppan-MC-MMAF-LEFIASKLA-P271 polypeptide
  MOD_RES (154)..(154): Ser at this position is modified with ppan-MC-MMAF

SEQ ID NO: 1233 - protein, 339 aa, Artificial Sequence; identical to SEQ ID NO: 301
  Description of Artificial Sequence: Synthetic anti-hHER2-HC-P271-DS-ppan-MC-MMAF-LEFIASKLA-E272 polypeptide
  MOD_RES (155)..(155): Ser at this position is modified with ppan-MC-MMAF

SEQ ID NO: 1234 - protein, 339 aa, Artificial Sequence; identical to SEQ ID NO: 302
  Description of Artificial Sequence: Synthetic anti-hHER2-HC-D280-DS-ppan-MC-MMAF-LEFIASKLA-G281 polypeptide
  MOD_RES (164)..(164): Ser at this position is modified with ppan-MC-MMAF

SEQ ID NO: 1235 - protein, 339 aa, Artificial Sequence; identical to SEQ ID NO: 303
  Description of Artificial Sequence: Synthetic anti-hHER2-HC-H285-DS-ppan-MC-MMAF-LEFIASKLA-N286 polypeptide
  MOD_RES (169)..(169): Ser at this position is modified with ppan-MC-MMAF

SEQ ID NO: 1236 - protein, 339 aa, Artificial Sequence; identical to SEQ ID NO: 304
  Description of Artificial Sequence: Synthetic anti-hHER2-HC-N286-DS-ppan-MC-MMAF-LEFIASKLA-A287 polypeptide
  MOD_RES (170)..(170): Ser at this position is modified with ppan-MC-MMAF

SEQ ID NO: 1237 - protein, 339 aa, Artificial Sequence; identical to SEQ ID NO: 305
  Description of Artificial Sequence: Synthetic anti-hHER2-HC-P291-DS-ppan-MC-MMAF-LEFIASKLA-R292 polypeptide
  MOD_RES (175)..(175): Ser at this position is modified with ppan-MC-MMAF

SEQ ID NO: 1238 - protein, 339 aa, Artificial Sequence; identical to SEQ ID NO: 310
  Description of Artificial Sequence: Synthetic anti-hHER2-HC-N315-DS-ppan-MC-MMAF-LEFIASKLA-G316 polypeptide
  MOD_RES (199)..(199): Ser at this position is modified with ppan-MC-MMAF

SEQ ID NO: 1239 - protein, 339 aa, Artificial Sequence; identical to SEQ ID NO: 311
  Description of Artificial Sequence: Synthetic anti-hHER2-HC-G316-DS-ppan-MC-MMAF-LEFIASKLA-K317 polypeptide
  MOD_RES (200)..(200): Ser at this position is modified with ppan-MC-MMAF

SEQ ID NO: 1240 - protein, 339 aa, Artificial Sequence; identical to SEQ ID NO: 312
  Description of Artificial Sequence: Synthetic anti-hHER2-HC-K317-DS-ppan-MC-MMAF-LEFIASKLA-E318 polypeptide
  MOD_RES (201)..(201): Ser at this position is modified with ppan-MC-MMAF

SEQ ID NO: 1241 - protein, 339 aa, Artificial Sequence; identical to SEQ ID NO: 313
  Description of Artificial Sequence: Synthetic anti-hHER2-HC-K326-DS-ppan-MC-MMAF-LEFIASKLA-A327 polypeptide
  MOD_RES (210)..(210): Ser at this position is modified with ppan-MC-MMAF

SEQ ID NO: 1242 - protein, 339 aa, Artificial Sequence; identical to SEQ ID NO: 314
  Description of Artificial Sequence: Synthetic anti-hHER2-HC-A327-DS-ppan-MC-MMAF-LEFIASKLA-L328 polypeptide
  MOD_RES (211)..(211): Ser at this position is modified with ppan-MC-MMAF

SEQ ID NO: 1243 - protein, 339 aa, Artificial Sequence; identical to SEQ ID NO: 315
  Description of Artificial Sequence: Synthetic anti-hHER2-HC-L328-DS-ppan-MC-MMAF-LEFIASKLA-P329 polypeptide
  MOD_RES (212)..(212): Ser at this position is modified with ppan-MC-MMAF

SEQ ID NO: 1244 - protein, 339 aa, Artificial Sequence; identical to SEQ ID NO: 316
  Description of Artificial Sequence: Synthetic anti-hHER2-HC-P329-DS-ppan-MC-MMAF-LEFIASKLA-A330 polypeptide
  MOD_RES (213)..(213): Ser at this position is modified with ppan-MC-MMAF

SEQ ID NO: 1245 - protein, 339 aa, Artificial Sequence; identical to SEQ ID NO: 317
  Description of Artificial Sequence: Synthetic anti-hHER2-HC-A330-DS-ppan-MC-MMAF-LEFIASKLA-P331 polypeptide
  MOD_RES (214)..(214): Ser at this position is modified with ppan-MC-MMAF

SEQ ID NO: 1246 - protein, 339 aa, Artificial Sequence; identical to SEQ ID NO: 318
  Description of Artificial Sequence: Synthetic anti-hHER2-HC-A339-DS-ppan-MC-MMAF-LEFIASKLA-K340 polypeptide
  MOD_RES (223)..(223): Ser at this position is modified with ppan-MC-MMAF

SEQ ID NO: 1247 - protein, 339 aa, Artificial Sequence; identical to SEQ ID NO: 319
  Description of Artificial Sequence: Synthetic anti-hHER2-HC-K340-DS-ppan-MC-MMAF-LEFIASKLA-G341 polypeptide
  MOD_RES (224)..(224): Ser at this position is modified with ppan-MC-MMAF

SEQ ID NO: 1248 - protein, 339 aa, Artificial Sequence; identical to SEQ ID NO: 320
  Description of Artificial Sequence: Synthetic anti-hHER2-HC-G341-DS-ppan-MC-MMAF-LEFIASKLA-Q342 polypeptide
  MOD_RES (225)..(225): Ser at this position is modified with ppan-MC-MMAF

SEQ ID NO: 1249 - protein, 339 aa, Artificial Sequence; identical to SEQ ID NO: 321
  Description of Artificial Sequence: Synthetic anti-hHER2-HC-Q342-DS-ppan-MC-MMAF-LEFIASKLA-P343 polypeptide
  MOD_RES (226)..(226): Ser at this position is modified with ppan-MC-MMAF

SEQ ID NO: 1250 - protein, 339 aa, Artificial Sequence; identical to SEQ ID NO: 322
  Description of Artificial Sequence: Synthetic anti-hHER2-HC-P343-DS-ppan-MC-MMAF-LEFIASKLA-R344 polypeptide
  MOD_RES (227)..(227): Ser at this position is modified with ppan-MC-MMAF

SEQ ID NO: 1251 - protein, 339 aa, Artificial Sequence; identical to SEQ ID NO: 323
  Description of Artificial Sequence: Synthetic anti-hHER2-HC-R344-DS-ppan-MC-MMAF-LEFIASKLA-E345 polypeptide
  MOD_RES (228)..(228): Ser at this position is modified with ppan-MC-MMAF

SEQ ID NO: 1252 - protein, 339 aa, Artificial Sequence; identical to SEQ ID NO: 325
  Description of Artificial Sequence: Synthetic anti-hHER2-HC-E356-DS-ppan-MC-MMAF-LEFIASKLA-E357 polypeptide
  MOD_RES (240)..(240): Ser at this position is modified with ppan-MC-MMAF

SEQ ID NO: 1253 - protein, 339 aa, Artificial Sequence; identical to SEQ ID NO: 327
  Description of Artificial Sequence: Synthetic anti-hHER2-HC-M358-DS-ppan-MC-MMAF-LEFIASKLA-T359 polypeptide
  MOD_RES (242)..(242): Ser at this position is modified with ppan-MC-MMAF

SEQ ID NO: 1254 - protein, 339 aa, Artificial Sequence; identical to SEQ ID NO: 328
  Description of Artificial Sequence: Synthetic anti-hHER2-HC-K360-DS-ppan-MC-MMAF-LEFIASKLA-N361 polypeptide
  MOD_RES (244)..(244): Ser at this position is modified with ppan-MC-MMAF

SEQ ID NO: 1255 - protein, 339 aa, Artificial Sequence; identical to SEQ ID NO: 329
  Description of Artificial Sequence: Synthetic anti-hHER2-HC-N384-DS-ppan-MC-MMAF-LEFIASKLA-G385 polypeptide
  MOD_RES (268)..(268): Ser at this position is modified with ppan-MC-MMAF

SEQ ID NO: 1256 - protein, 339 aa, Artificial Sequence; identical to SEQ ID NO: 330
  Description of Artificial Sequence: Synthetic anti-hHER2-HC-N389-DS-ppan-MC-MMAF-LEFIASKLA-N390 polypeptide
  MOD_RES (273)..(273): Ser at this position is modified with ppan-MC-MMAF

SEQ ID NO: 1257 - protein, 339 aa, Artificial Sequence; identical to SEQ ID NO: 332
  Description of Artificial Sequence: Synthetic anti-hHER2-HC-P395-DS-ppan-MC-MMAF-LEFIASKLA-P396 polypeptide
  MOD_RES (279)..(279): Ser at this position is modified with ppan-MC-MMAF

SEQ ID NO: 1258 - protein, 339 aa, Artificial Sequence; identical to SEQ ID NO: 333
  Description of Artificial Sequence: Synthetic anti-hHER2-HC-D399-DS-ppan-MC-MMAF-LEFIASKLA-S400 polypeptide
  MOD_RES (283)..(283): Ser at this position is modified with ppan-MC-MMAF

SEQ ID NO: 1259 - protein, 339 aa, Artificial Sequence; identical to SEQ ID NO: 335
  Description of Artificial Sequence: Synthetic anti-hHER2-HC-D401-DS-ppan-MC-MMAF-LEFIASKLA-G402 polypeptide
  MOD_RES (285)..(285): Ser at this position is modified with ppan-MC-MMAF

SEQ ID NO: 1260 - protein, 339 aa, Artificial Sequence; identical to SEQ ID NO: 336
  Description of Artificial Sequence: Synthetic anti-hHER2-HC-S415-DS-ppan-MC-MMAF-LEFIASKLA-R416 polypeptide
  MOD_RES (299)..(299): Ser at this position is modified with ppan-MC-MMAF

SEQ ID NO: 1261 - protein, 339 aa, Artificial Sequence; identical to SEQ ID NO: 337
  Description of Artificial Sequence: Synthetic anti-hHER2-HC-R416-DS-ppan-MC-MMAF-LEFIASKLA-W417 polypeptide
  MOD_RES (300)..(300): Ser at this position is modified with ppan-MC-MMAF

SEQ ID NO: 1262 - protein, 339 aa, Artificial Sequence; identical to SEQ ID NO: 338
  Description of Artificial Sequence: Synthetic anti-hHER2-HC-W417-DS-ppan-MC-MMAF-LEFIASKLA-Q418 polypeptide
  MOD_RES (301)..(301): Ser at this position is modified with ppan-MC-MMAF

SEQ ID NO: 1263 - protein, 339 aa, Artificial Sequence; identical to SEQ ID NO: 339
  Description of Artificial Sequence: Synthetic anti-hHER2-HC-Q418-DS-ppan-MC-MMAF-LEFIASKLA-Q419 polypeptide
  MOD_RES (302)..(302): Ser at this position is modified with ppan-MC-MMAF

SEQ ID NO: 1264 - protein, 339 aa, Artificial Sequence; identical to SEQ ID NO: 340
  Description of Artificial Sequence: Synthetic anti-hHER2-HC-Q419-DS-ppan-MC-MMAF-LEFIASKLA-G420 polypeptide
  MOD_RES (303)..(303): Ser at this position is modified with ppan-MC-MMAF

SEQ ID NO: 1265 - protein, 339 aa, Artificial Sequence; identical to SEQ ID NO: 341
  Description of Artificial Sequence: Synthetic anti-hHER2-HC-G420-DS-ppan-MC-MMAF-LEFIASKLA-N421 polypeptide
  MOD_RES (304)..(304): Ser at this position is modified with ppan-MC-MMAF

SEQ ID NO: 1266 - protein, 339 aa, Artificial Sequence; identical to SEQ ID NO: 342
  Description of Artificial Sequence: Synthetic anti-hHER2-HC-N421-DS-ppan-MC-MMAF-LEFIASKLA-V422 polypeptide
  MOD_RES (305)..(305): Ser at this position is modified with ppan-MC-MMAF

SEQ ID NO: 1267 - protein, 339 aa, Artificial Sequence; identical to SEQ ID NO: 343
  Description of Artificial Sequence: Synthetic anti-hHER2-HC-H433-DS-ppan-MC-MMAF-LEFIASKLA-N434 polypeptide
  MOD_RES (317)..(317): Ser at this position is modified with ppan-MC-MMAF

SEQ ID NO: 1268 - protein, 339 aa, Artificial Sequence; identical to SEQ ID NO: 344
  Description of Artificial Sequence: Synthetic anti-hHER2-HC-N434-DS-ppan-MC-MMAF-LEFIASKLA-H435 polypeptide
  MOD_RES (318)..(318): Ser at this position is modified with ppan-MC-MMAF

SEQ ID NO: 1269 - protein, 339 aa, Artificial Sequence; identical to SEQ ID NO: 346
  Description of Artificial Sequence: Synthetic anti-hHER2-HC-L443-DS-ppan-MC-MMAF-LEFIASKLA-S444 polypeptide
  MOD_RES (327)..(327): Ser at this position is modified with ppan-MC-MMAF

SEQ ID NO: 1270 - protein, 339 aa, Artificial Sequence; identical to SEQ ID NO: 349
  Description of Artificial Sequence: Synthetic anti-hHER2-HC-G446-DS-ppan-MC-MMAF-LEFIASKLA-K447 polypeptide
  MOD_RES (330)..(330): Ser at this position is modified with ppan-MC-MMAF

SEQ ID NO: 1271 - protein, 118 aa, Artificial Sequence; identical to SEQ ID NO: 31
  Description of Artificial Sequence: Synthetic anti-hHER2-LC-T109-GDS-ppan-MC-MMAF-LSWLLRLLN-V110 polypeptide
  MOD_RES (4)..(4): Ser at this position is modified with ppan-MC-MMAF

SEQ ID NO: 1272 - protein, 118 aa, Artificial Sequence; identical to SEQ ID NO: 32
  Description of Artificial Sequence: Synthetic anti-hHER2-LC-V110-GDS-ppan-MC-MMAF-LSWLLRLLN-A111 polypeptide
  MOD_RES (5)..(5): Ser at this position is modified with ppan-MC-MMAF

SEQ ID NO: 1273 - protein, 118 aa, Artificial Sequence; identical to SEQ ID NO: 33
  Description of Artificial Sequence: Synthetic anti-hHER2-LC-A111-GDS-ppan-MC-MMAF-LSWLLRLLN-A112 polypeptide
  MOD_RES (6)..(6): Ser at this position is modified with ppan-MC-MMAF

SEQ ID NO: 1274 - protein, 118 aa, Artificial Sequence; identical to SEQ ID NO: 34
  Description of Artificial Sequence: Synthetic anti-hHER2-LC-P119-GDS-ppan-MC-MMAF-LSWLLRLLN-P120 polypeptide
  MOD_RES (14)..(14): Ser at this position is modified with ppan-MC-MMAF

SEQ ID NO: 1275 - protein, 118 aa, Artificial Sequence; identical to SEQ ID NO: 37
  Description of Artificial Sequence: Synthetic anti-hHER2-LC-D122-GDS-ppan-MC-MMAF-LSWLLRLLN-E123 polypeptide
  MOD_RES (17)..(17): Ser at this position is modified with ppan-MC-MMAF

SEQ ID NO: 1276 - protein, 118 aa, Artificial Sequence; identical to SEQ ID NO: 38
  Description of Artificial Sequence: Synthetic anti-hHER2-LC-Y140-GDS-ppan-MC-MMAF-LSWLLRLLN-P141 polypeptide
  MOD_RES (35)..(35): Ser at this position is modified with ppan-MC-MMAF

SEQ ID NO: 1277 - protein, 118 aa, Artificial Sequence; identical to SEQ ID NO: 39
  Description of Artificial Sequence: Synthetic anti-hHER2-LC-P141-GDS-ppan-MC-MMAF-LSWLLRLLN-R142 polypeptide
  MOD_RES (36)..(36): Ser at this position is modified with ppan-MC-MMAF

SEQ ID NO: 1278 - protein, 118 aa, Artificial Sequence; identical to SEQ ID NO: 40
  Description of Artificial Sequence: Synthetic anti-hHER2-LC-R142-GDS-ppan-MC-MMAF-LSWLLRLLN-E143 polypeptide
  MOD_RES (37)..(37): Ser at this position is modified with ppan-MC-MMAF

SEQ ID NO: 1279 - protein, 118 aa, Artificial Sequence; identical to SEQ ID NO: 41
  Description of Artificial Sequence: Synthetic anti-hHER2-LC-E143-GDS-ppan-MC-MMAF-LSWLLRLLN-A144 polypeptide
  MOD_RES (38)..(38): Ser at this position is modified with ppan-MC-MMAF

SEQ ID NO: 1280 - protein, 118 aa, Artificial Sequence; identical to SEQ ID NO: 42
  Description of Artificial Sequence: Synthetic anti-hHER2-LC-D151-GDS-ppan-MC-MMAF-LSWLLRLLN-N152 polypeptide
  MOD_RES (46)..(46): Ser at this position is modified with ppan-MC-MMAF

SEQ ID NO: 1281 - protein, 118 aa, Artificial Sequence; identical to SEQ ID NO: 43
  Description of Artificial Sequence: Synthetic anti-hHER2-LC-N152-GDS-ppan-MC-MMAF-LSWLLRLLN-A153 polypeptide
  MOD_RES (47)..(47): Ser at this position is modified with ppan-MC-MMAF

SEQ ID NO: 1282 - protein, 118 aa, Artificial Sequence; identical to SEQ ID NO: 44
  Description of Artificial Sequence: Synthetic anti-hHER2-LC-A153-GDS-ppan-MC-MMAF-LSWLLRLLN-L154 polypeptide
  MOD_RES (48)..(48): Ser at this position is modified with ppan-MC-MMAF

SEQ ID NO: 1283 - protein, 118 aa, Artificial Sequence; identical to SEQ ID NO: 45
  Description of Artificial Sequence: Synthetic anti-hHER2-LC-L154-GDS-ppan-MC-MMAF-LSWLLRLLN-Q155 polypeptide
  MOD_RES (49)..(49): Ser at this position is modified with ppan-MC-MMAF

SEQ ID NO: 1284 - protein, 118 aa, Artificial Sequence; identical to SEQ ID NO: 46
  Description of Artificial Sequence: Synthetic anti-hHER2-LC-Q155-GDS-ppan-MC-MMAF-LSWLLRLLN-S156 polypeptide
  MOD_RES (50)..(50): Ser at this position is modified with ppan-MC-MMAF

SEQ ID NO: 1285 - protein, 118 aa, Artificial Sequence; identical to SEQ ID NO: 47
  Description of Artificial Sequence: Synthetic anti-hHER2-LC-E161-GDS-ppan-MC-MMAF-LSWLLRLLN-S162 polypeptide
  MOD_RES (56)..(56): Ser at this position is modified with ppan-MC-MMAF

SEQ ID NO: 1286 - protein, 118 aa, Artificial Sequence; identical to SEQ ID NO: 48
  Description of Artificial Sequence: Synthetic anti-hHER2-LC-S162-GDS-ppan-MC-MMAF-LSWLLRLLN-V163 polypeptide
  MOD_RES (57)..(57): Ser at this position is modified with ppan-MC-MMAF

SEQ ID NO: 1287 - protein, 118 aa, Artificial Sequence; identical to SEQ ID NO: 50
  Description of Artificial Sequence: Synthetic anti-hHER2-LC-T164-GDS-ppan-MC-MMAF-LSWLLRLLN-E165 polypeptide
  MOD_RES (59)..(59): Ser at this position is modified with ppan-MC-MMAF

SEQ ID NO: 1288 - protein, 118 aa, Artificial Sequence; identical to SEQ ID NO: 51
  Description of Artificial Sequence: Synthetic anti-hHER2-LC-E165-GDS-ppan-MC-MMAF-LSWLLRLLN-Q166 polypeptide
  MOD_RES (60)..(60): Ser at this position is modified with ppan-MC-MMAF

SEQ ID NO: 1289 - protein, 118 aa, Artificial Sequence; identical to SEQ ID NO: 52
  Description of Artificial Sequence: Synthetic anti-hHER2-LC-Q166-GDS-ppan-MC-MMAF-LSWLLRLLN-D167 polypeptide
  MOD_RES (61)..(61): Ser at this position is modified with ppan-MC-MMAF

SEQ ID NO: 1290 - protein, 118 aa, Artificial Sequence; identical to SEQ ID NO: 53
  Description of Artificial Sequence: Synthetic anti-hHER2-LC-D167-GDS-ppan-MC-MMAF-LSWLLRLLN-S168 polypeptide
  MOD_RES (62)..(62): Ser at this position is modified with ppan-MC-MMAF

SEQ ID NO: 1291 - protein, 118 aa, Artificial Sequence; identical to SEQ ID NO: 54
  Description of Artificial Sequence: Synthetic anti-hHER2-LC-T197-GDS-ppan-MC-MMAF-LSWLLRLLN-H198 polypeptide
  MOD_RES (92)..(92): Ser at this position is modified with ppan-MC-MMAF

SEQ ID NO: 1292 - protein, 118 aa, Artificial Sequence; identical to SEQ ID NO: 56
  Description of Artificial Sequence: Synthetic anti-hHER2-LC-Q199-GDS-ppan-MC-MMAF-LSWLLRLLN-G200 polypeptide
  MOD_RES (94)..(94): Ser at this position is modified with ppan-MC-MMAF

SEQ ID NO: 1293 - protein, 118 aa, Artificial Sequence; identical to SEQ ID NO: 59
  Description of Artificial Sequence: Synthetic anti-hHER2-LC-S202-GDS-ppan-MC-MMAF-LSWLLRLLN-S203 polypeptide
  MOD_RES (97)..(97): Ser at this position is modified with ppan-MC-MMAF

SEQ ID NO: 1294 - protein, 117 aa, Artificial Sequence; identical to SEQ ID NO: 63
  Description of Artificial Sequence: Synthetic anti-hHER2-LC-V110-DS-ppan-MC-MMAF-LEFIASKLA-A111 polypeptide
  MOD_RES (4)..(4): Ser at this position is modified with ppan-MC-MMAF

SEQ ID NO: 1295 - protein, 117 aa, Artificial Sequence; identical to SEQ ID NO: 64
  Description of Artificial Sequence: Synthetic anti-hHER2-LC-A111-DS-ppan-MC-MMAF-LEFIASKLA-A112 polypeptide
  MOD_RES (5)..(5): Ser at this position is modified with ppan-MC-MMAF

SEQ ID NO: 1296 - protein, 117 aa, Artificial Sequence; identical to SEQ ID NO: 65
  Description of Artificial Sequence: Synthetic anti-hHER2-LC-P119-DS-ppan-MC-MMAF-LEFIASKLA-P120 polypeptide
  MOD_RES (13)..(13): Ser at this position is modified with ppan-MC-MMAF

SEQ ID NO: 1297 - protein, 117 aa, Artificial Sequence; identical to SEQ ID NO: 66
  Description of Artificial Sequence: Synthetic anti-hHER2-LC-P120-DS-ppan-MC-MMAF-LEFIASKLA-S121 polypeptide
  MOD_RES (14)..(14): Ser at this position is modified with ppan-MC-MMAF

SEQ ID NO: 1298 - protein, 117 aa, Artificial Sequence; identical to SEQ ID NO: 67
  Description of Artificial Sequence: Synthetic anti-hHER2-LC-S121-DS-ppan-MC-MMAF-LEFIASKLA-D122 polypeptide
  MOD_RES (15)..(15): Ser at this position is modified with ppan-MC-MMAF

SEQ ID NO: 1299 - protein, 117 aa, Artificial Sequence; identical to SEQ ID NO: 68
  Description of Artificial Sequence: Synthetic anti-hHER2-LC-D122-DS-ppan-MC-MMAF-LEFIASKLA-E123 polypeptide
  MOD_RES (16)..(16): Ser at this position is modified with ppan-MC-MMAF

SEQ ID NO: 1300 - protein, 117 aa, Artificial Sequence; identical to SEQ ID NO: 69
  Description of Artificial Sequence: Synthetic anti-hHER2-LC-Y140-DS-ppan-MC-MMAF-LEFIASKLA-P141 polypeptide
  MOD_RES (34)..(34): Ser at this position is modified with ppan-MC-MMAF

SEQ ID NO: 1301 - protein, 117 aa, Artificial Sequence; identical to SEQ ID NO: 71
  Description of Artificial Sequence: Synthetic anti-hHER2-LC-R142-DS-ppan-MC-MMAF-LEFIASKLA-E143 polypeptide
  MOD_RES (36)..(36): Ser at this position is modified with ppan-MC-MMAF

SEQ ID NO: 1302 - protein, 117 aa, Artificial Sequence; identical to SEQ ID NO: 72
  Description of Artificial Sequence: Synthetic anti-hHER2-LC-E143-DS-ppan-MC-MMAF-LEFIASKLA-A144 polypeptide
  MOD_RES (37)..(37): Ser at this position is modified with ppan-MC-MMAF

SEQ ID NO: 1303 - protein, 117 aa, Artificial Sequence; identical to SEQ ID NO: 73
  Description of Artificial Sequence: Synthetic anti-hHER2-LC-D151-DS-ppan-MC-MMAF-LEFIASKLA-N152 polypeptide
  MOD_RES (45)..(45): Ser at this position is modified with ppan-MC-MMAF

SEQ ID NO: 1304 - protein, 117 aa, Artificial Sequence; identical to SEQ ID NO: 74
  Description of Artificial Sequence: Synthetic anti-hHER2-LC-N152-DS-ppan-MC-MMAF-LEFIASKLA-A153 polypeptide
  MOD_RES (46)..(46): Ser at this position is modified with ppan-MC-MMAF

SEQ ID NO: 1305 - protein, 117 aa, Artificial Sequence; identical to SEQ ID NO: 75
  Description of Artificial Sequence: Synthetic anti-hHER2-LC-A153-DS-ppan-MC-MMAF-LEFIASKLA-L154 polypeptide
  MOD_RES (47)..(47): Ser at this position is modified with ppan-MC-MMAF

SEQ ID NO: 1306 - protein, 117 aa, Artificial Sequence; identical to SEQ ID NO: 76
  Description of Artificial Sequence: Synthetic anti-hHER2-LC-L154-DS-ppan-MC-MMAF-LEFIASKLA-Q155 polypeptide
  MOD_RES (48)..(48): Ser at this position is modified with ppan-MC-MMAF

SEQ ID NO: 1307 - protein, 117 aa, Artificial Sequence; identical to SEQ ID NO: 77
  Description of Artificial Sequence: Synthetic anti-hHER2-LC-Q155-DS-ppan-MC-MMAF-LEFIASKLA-S156 polypeptide
  MOD_RES (49)..(49): Ser at this position is modified with ppan-MC-MMAF

SEQ ID NO: 1308 - protein, 117 aa, Artificial Sequence; identical to SEQ ID NO: 79
  Description of Artificial Sequence: Synthetic anti-hHER2-LC-S162-DS-ppan-MC-MMAF-LEFIASKLA-V163 polypeptide
  MOD_RES (56)..(56): Ser at this position is modified with ppan-MC-MMAF

SEQ ID NO: 1309 - protein, 117 aa, Artificial Sequence; identical to SEQ ID NO: 81
  Description of Artificial Sequence: Synthetic anti-hHER2-LC-T164-DS-ppan-MC-MMAF-LEFIASKLA-E165 polypeptide
  MOD_RES (58)..(58): Ser at this position is modified with ppan-MC-MMAF

SEQ ID NO: 1310 - protein, 117 aa, Artificial Sequence; identical to SEQ ID NO: 82
  Description of Artificial Sequence: Synthetic anti-hHER2-LC-E165-DS-ppan-MC-MMAF-LEFIASKLA-Q166 polypeptide
  MOD_RES (59)..(59): Ser at this position is modified with ppan-MC-MMAF

SEQ ID NO: 1311 - protein, 117 aa, Artificial Sequence; identical to SEQ ID NO: 83
  Description of Artificial Sequence: Synthetic anti-hHER2-LC-Q166-DS-ppan-MC-MMAF-LEFIASKLA-D167 polypeptide
  MOD_RES (60)..(60): Ser at this position is modified with ppan-MC-MMAF

SEQ ID NO: 1312 - protein, 117 aa, Artificial Sequence; identical to SEQ ID NO: 84
  Description of Artificial Sequence: Synthetic anti-hHER2-LC-D167-DS-ppan-MC-MMAF-LEFIASKLA-S168 polypeptide
  MOD_RES (61)..(61): Ser at this position is modified with ppan-MC-MMAF

SEQ ID NO: 1313 - protein, 117 aa, Artificial Sequence; identical to SEQ ID NO: 85
  Description of Artificial Sequence: Synthetic anti-hHER2-LC-T197-DS-ppan-MC-MMAF-LEFIASKLA-H198 polypeptide
  MOD_RES (91)..(91): Ser at this position is modified with ppan-MC-MMAF

SEQ ID NO: 1314 - protein, 117 aa, Artificial Sequence; identical to SEQ ID NO: 87
  Description of Artificial Sequence: Synthetic anti-hHER2-LC-Q199-DS-ppan-MC-MMAF-LEFIASKLA-G200 polypeptide
  MOD_RES (93)..(93): Ser at this position is modified with ppan-MC-MMAF

SEQ ID NO: 1315 - protein, 117 aa, Artificial Sequence; identical to SEQ ID NO: 88
  Description of Artificial Sequence: Synthetic anti-hHER2-LC-G200-DS-ppan-MC-MMAF-LEFIASKLA-L201 polypeptide
  MOD_RES (94)..(94): Ser at this position is modified with ppan-MC-MMAF

SEQ ID NO: 1316 - protein, 117 aa, Artificial Sequence; identical to SEQ ID NO: 89
  Description of Artificial Sequence: Synthetic anti-hHER2-LC-L201-DS-ppan-MC-MMAF-LEFIASKLA-S202 polypeptide
  MOD_RES (95)..(95): Ser at this position is modified with ppan-MC-MMAF

SEQ ID NO: 1317 - protein, 77 aa, Artificial Sequence
  Description of Artificial Sequence: Synthetic polypeptide
NSLRAEDTAVYYCSRWGGDGFYAMDYWGQGTLVTVSSASTKGPSVFPLAPSDSLEFIASKLAGCLVKDYFPEPVTVS

SEQ ID NO: 1318 - protein, 77 aa, Artificial Sequence
  Description of Artificial Sequence: Synthetic polypeptide
NSLRAEDTAVYYCSRWGGDGFYAMDYWGQGTLVTVSSASTKGPSVFPLAPSGDSLSWLLRLLNCLVKDYFPEPVTVS

SEQ ID NO: 1319 - protein, 77 aa, Artificial Sequence
  Description of Artificial Sequence: Synthetic polypeptide
NSLRAEDTAVYYCSRWGGDGFYAMDYWGQGTLVTVSSASTKGPSVFPLAPSSKGDSLSWLALGCLVKDYFPEPVTVS

SEQ ID NO: 1320 - protein, 77 aa, Artificial Sequence
  Description of Artificial Sequence: Synthetic polypeptide
NSLRAEDTAVYYCSRWGGDGFYAMDYWGQGTLVTVSSASTKGPSVFPLAPSSKGDSLSWLLRLLNVKDYFPEPVTVS

SEQ ID NO: 1321 - protein, 69 aa, Artificial Sequence
  Description of Artificial Sequence: Synthetic polypeptide
NSLRAEDTAVYYCSRWGGDGFYAMDYWGQGTLVTVSSASTKGPSVFPLAPSSKSTSGGTAALGCLVKDY

SEQ ID NO: 1322 - protein, 76 aa, Artificial Sequence
  Description of Artificial Sequence: Synthetic polypeptide
NSLRAEDTAVYYCSRWGGDGFYAMDYWGQGTLVTVSSASTKGPSVFPLAPSSKSGDSLSWLLRLLNAALGCLVKDY

SEQ ID NO: 1323 - protein, 75 aa, Artificial Sequence
  Description of Artificial Sequence: Synthetic polypeptide
NSLRAEDTAVYYCSRWGGDGFYAMDYWGQGTLVTVSSASTKGPSVFPLAPSSGDSLSWLLRLLNTAALGCLVKDY

SEQ ID NO: 1324 - protein, 74 aa, Artificial Sequence
  Description of Artificial Sequence: Synthetic polypeptide
NSLRAEDTAVYYCSRWGGDGFYAMDYWGQGTLVTVSSASTKGPSVFPLAPSSKGDSLSWLLRLLNALGCLVKDY

SEQ ID NO: 1325 - protein, 68 aa, Artificial Sequence
  Description of Artificial Sequence: Synthetic polypeptide
GALTSGVHTFPAVLQSSGLYSLSSVVTVPSSSLGTQTYICNVNHKPSNTKVDKKVEPKSCDKTHTCPP

SEQ ID NO: 1326 - protein, 77 aa, Artificial Sequence
  Description of Artificial Sequence: Synthetic polypeptide
GALTSGVHTFPAVLQSSGLYSLSSVVTVPSSSLGTQTYICNVNHKPSNTKVDKKVEPKSCDKTHTCPPCPAPELLGG

SEQ ID NO: 1327 - protein, 77 aa, Artificial Sequence
  Description of Artificial Sequence: Synthetic polypeptide
CKVSNKALPAPIEKTISKAKGQPREPQVYTLPPSREEMTKNQVSLTCLVKGFYPSDIAVEWESNGQPENNYKTTPPV

SEQ ID NO: 1328 - protein, 65 aa, Artificial Sequence
  Description of Artificial Sequence: Synthetic polypeptide
CKVSNKALPAPIEKTISKAKGQPREPQVYTLPPSREEMTKNQVSLTCLVKGFYPSDIAVEWESNG

SEQ ID NO: 1329 - protein, 77 aa, Artificial Sequence
  Description of Artificial Sequence: Synthetic polypeptide
KGFYPSDIAVEWESNGQPENNYKTTPPVLDSDGSFFLYSKLTVDKSRWQQGNVFSCSVMHEALHNHYTQKSLSLSPG

SEQ ID NO: 1330 - protein, 72 aa, Artificial Sequence
  Description of Artificial Sequence: Synthetic polypeptide
KGFYPSDIAVEWESNGQPENNYKTTPPVLDSDGSFFLYSKLTVDKSRWQQGNVFSCSVMHEALHNHYTQKSL

SEQ ID NO: 1331 - protein, 60 aa, Artificial Sequence
  Description of Artificial Sequence: Synthetic polypeptide
PENNYKTTPPVLDSDGSFFLYSKLTVDKSRWQQGNVFSCSVMHEALHNHYTQKSLSLSPG

SEQ ID NO: 1332 - protein, 67 aa, Artificial Sequence
  Description of Artificial Sequence: Synthetic polypeptide
EWESNGQPENNYKTTPPVLDSDGSFFLYSKLTVDKSRWQQGNVFSCSVMHEALHNHYTQKSLSLSPG

SEQ ID NO: 1333 - protein, 68 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSG

SEQ ID NO: 1334 - protein, 77 aa, Artificial Sequence
  Description of Artificial Sequence: Synthetic polypeptide
SSLQPEDFATYYCQQHYTTPPTFGQGTKVEIKRTVAAPSVFIFPPSDEQLKSGTASVVCLLNNFYPREAKVQWKVDN

SEQ ID NO: 1335 - protein, 65 aa, Artificial Sequence
  Description of Artificial Sequence: Synthetic polypeptide
VDNALQSGNSQESVTEQDSKDSTYSLSSTLTLSKADYEKHKVYACEVTHQGLSSPVTKSFNRGEC

SEQ ID NO: 1336 - protein, 80 aa, Artificial Sequence
  Description of Artificial Sequence: Synthetic polypeptide
EWESNGQPENNYKTTPPVLDSDGSFFLYSKLTVDKSRWQQGNVFSCSVMHEALHNHYTQKSLSLSPGGDSLSWLLRLLNK

What is claimed is:

1. A modified antibody or antigen binding fragment thereof, wherein said wherein said antibody comprises an amino acid sequence selected from SEQ ID NO:26, SEQ ID NO:27, SEQ ID NO:32, SEQ ID NO:63, SEQ ID NO:94, SEQ ID NO:95, SEQ ID NO:96, SEQ ID NO:126, SEQ ID NO:127, SEQ ID NO:129, SEQ ID NO:130, SEQ ID NO:131, SEQ ID NO:132, SEQ ID NO:139, SEQ ID NO:149, SEQ ID NO:151, SEQ ID NO:152, SEQ ID NO:157, SEQ ID NO:158, SEQ ID NO:160, SEQ ID NO:168, SEQ ID NO:169, SEQ ID NO:178, SEQ ID NO:248, SEQ ID NO:250, SEQ ID NO:251, SEQ ID NO:256, SEQ ID NO:257, SEQ ID NO:259, SEQ ID NO:267, SEQ ID NO:268, SEQ ID NO:277, SEQ ID NO:348, SEQ ID NO:349, SEQ ID NO:356, SEQ ID NO:358, SEQ ID NO:359, SEQ ID NO:364, SEQ ID NO:365, SEQ ID NO:367, SEQ ID NO:373, SEQ ID NO:374, SEQ ID NO:380, SEQ ID NO:384, SEQ ID NO:386, SEQ ID NO:387, or SEQ ID NO:388.

2. An immunoconjugate comprising the modified antibody or antigen binding fragment thereof of claim 1, and a terminal group, wherein said terminal group is attached to the modified antibody or antigen binding fragment by a linker having the structure according to Formula (I-b):

Formula (I-b)

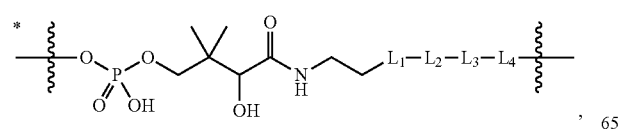

wherein:

a) L$_1$ is -A$_1$X$^2$—, wherein A$_1$ is —C(=O)NH(CH$_2$)$_n$S— and X$^2$ is

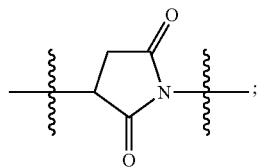 [SMILES: *C1CC(=O)N(*)C1=O]

L$_2$ is -A$_2$-, wherein A$_2$ is —(CH$_2$)$_n$C(=O);

L$_3$ is -A$_3$-, wherein A$_3$ is

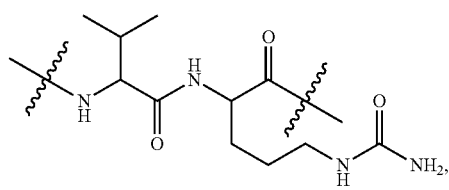 [SMILES: *NC(C(=O)NC(CCCNC(N)=O)C(*)=O)C(C)C]

and L₄ is

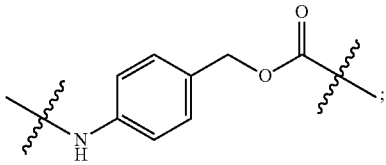 [SMILES: *Nc1ccc(COC(*)=O)cc1]

b) L is a -A₁X²—, wherein A₁ is —C(=O)NH(CH₂)ₙS— and X² is —(CH₂)ₙC(=O)NH—;
L₂ is a bond-; L₃ is -A₃-, wherein A₃ is —(CH₂)ₙC(=O)—, and L₄ is a bond;

c) L₁ is a -A₁X²—, wherein A₁ is —C(=O)NH(CH₂)ₙS—, X² is —CHR⁴(CH₂)ₙC(=O)NH— and R⁴ is —C(=O)OH;
L₂ is a bond; L₃ is -A₃-, wherein A₃ is —(CH₂)ₙC(=O)— and, L₄ is a bond;

d) L₁ is -A₁X²—, where A₁ is —C(=O)NH(CH₂)ₙS— and X² is —(CH₂)ₙC(=O)NH—;
L₂ is a bond; L₃ is a bond, and L₄ is -A₄- wherein A₄ is —(CH₂)ₙNHC(=O)—;

e) L₁ is -A₁X²—, wherein A₁ is —C(=O)NH(CH₂)ₙS— and X² is —(CH₂)ₙC(=O)NH—;
L₂ is a bond; L₃ is a bond; L₄ is -A₄-, wherein A₄ is —(CH₂)ₙC(=O)—;

f) L₁ is -A₁X²—, wherein A₁ is —C(=O)NH(CH₂)ₙS— and X² is —(CH₂)ₙC(=O)NH—;
L₂ is -A₂-, wherein A₂ is —(CH₂)ₙC(=O;
L₃ is -A₃-, wherein A₃ is

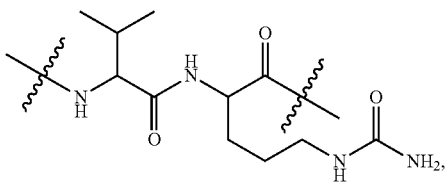 [SMILES: *NC(C(=O)NC(CCCNC(N)=O)C(*)=O)C(C)C]

and L₄ is

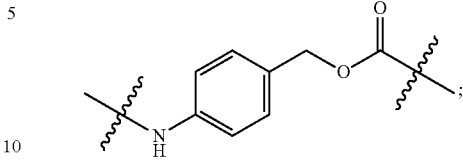

g) L₁ is a -A₁X²—, wherein A₁ is —C(=O)NH(CH₂)ₙS— and X² is —(CH₂)ₙC(=O)NH—;
L₂ is a bond-; L₃ is -A₃-, wherein A₃ is —(CH₂)ₙC(=O)—, and L₄ is a bond; or h) L₁ is a -A₁X²—, wherein A₁ is —C(=O)NH(CH₂)ₙS—, X² is —CHR⁴(CH₂)ₙC(=O)NH— and R⁴ is —C(=O)OH;
L₂ is a bond; L₃ is -A₃-, wherein A₃ is —(CH₂)ₙC(=O)—, and L₄ is a bond.

3. The immunoconjugate of claim 2, wherein the terminal group is a moiety selected from an anti-inflammatory agent, an anticancer agent, an antifungal agent, an antibacterial agent, an anti-parasitic agent, an anti-viral agent and an anesthetic agent.

4. The immunoconjugate of claim 3, wherein the terminal group is selected from a V-ATPase inhibitor, a HSP90 inhibitor, an IAP inhibitor, an mTor inhibitor, a microtubule stabilizer, a microtubule destabilizers, an auristatin, a dolastatin, a maytansinoid, a MetAP (methionine aminopeptidase), an inhibitor of nuclear export of proteins CRM1, a DPPIV inhibitor, an inhibitors of phosphoryl transfer reactions in mitochondria, a protein synthesis inhibitor, a CDK2 inhibitor, a CDK9 inhibitor, an EG5 inhibitor, an HDAC inhibitor, a DNA damaging agent, a DNA alkylating agent, a DNA intercalator, a DNA minor groove binder, a proteasome inhibitor, and a DHFR inhibitor.

5. The immunoconjugate of claim 2, wherein the terminal group is selected from a fluorophore, a chromophore, a quantum dot, a magnetic probe, a radioactive probe, an imaging reagent, or a contrast reagent.

6. A method of treating a Her2 positive cancer comprising administering to a human in need thereof an effective amount of the immunoconjugate of claim 2 or a pharmaceutical composition thereof.

* * * * *